US007691977B2

(12) United States Patent
Fuh et al.

(10) Patent No.: US 7,691,977 B2
(45) Date of Patent: *Apr. 6, 2010

(54) ANTI-VEGF ANTIBODIES

(75) Inventors: Germaine Fuh, Pacifica, CA (US); Hans-Peter Gerber, Bellevue, WA (US); Wei-Ching Liang, Foster City, CA (US); Frederic A. Fellouse, Toronto (CA); Sachdev S. Sidhu, San Francisco, CA (US); Christian Wiesmann, Brisbane, CA (US)

(73) Assignee: Genentech, Inc., South San Francisco, CA (US)

( * ) Notice: Subject to any disclaimer, the term of this patent is extended or adjusted under 35 U.S.C. 154(b) by 0 days.

This patent is subject to a terminal disclaimer.

(21) Appl. No.: 11/583,994

(22) Filed: Oct. 19, 2006

(65) Prior Publication Data

US 2007/0141065 A1 Jun. 21, 2007

Related U.S. Application Data

(63) Continuation of application No. 11/342,249, filed on Jan. 27, 2006, which is a continuation of application No. PCT/US2004/024662, filed on Jul. 30, 2004.

(60) Provisional application No. 60/491,877, filed on Aug. 1, 2003, provisional application No. 60/516,495, filed on Nov. 1, 2003, provisional application No. 60/570,912, filed on May 12, 2004, provisional application No. 60/571,239, filed on May 13, 2004, provisional application No. 60/576,315, filed on Jun. 1, 2004, provisional application No. 60/580,757, filed on Jun. 18, 2004.

(51) Int. Cl.
*C12P 21/08* (2006.01)
*A61K 39/395* (2006.01)
*A61K 51/08* (2006.01)

(52) U.S. Cl. .............. 530/387.1; 530/387.3; 530/388.1; 530/388.15; 530/388.23; 424/130.1; 424/133.1; 424/136.1; 424/141.1; 424/142.1; 424/145.1

(58) Field of Classification Search ........................ None
See application file for complete search history.

(56) References Cited

U.S. PATENT DOCUMENTS

| | | | |
|---|---|---|---|
| 4,774,378 A | 9/1988 | Faure et al. |
| 4,816,567 A | 3/1989 | Cabilly et al. |
| 5,427,908 A | 6/1995 | Dower et al. |
| 5,432,018 A | 7/1995 | Dower et al. |
| 5,498,530 A | 3/1996 | Schatz et al. |
| 5,580,717 A | 12/1996 | Dower et al. |
| 5,658,727 A | 8/1997 | Barbas et al. |
| 5,688,666 A | 11/1997 | Bass et al. |
| 5,723,286 A | 3/1998 | Dower et al. |
| 5,733,743 A | 3/1998 | Johnson et al. |
| 5,750,373 A | 5/1998 | Garrard et al. |
| 5,821,337 A | 10/1998 | Carter et al. |
| 5,837,242 A | 11/1998 | Holliger et al. |
| 5,928,641 A | 7/1999 | Seon |
| 5,969,108 A | 10/1999 | McCafferty et al. |
| 6,054,297 A | 4/2000 | Carter et al. |
| 6,172,197 B1 | 1/2001 | McCafferty et al. |
| 6,342,219 B1 | 1/2002 | Thorpe et al. |
| 6,416,758 B1 | 7/2002 | Thorpe et al. |
| 6,884,879 B1 | 4/2005 | Baca et al. |
| 7,208,582 B2 | 4/2007 | Rosen et al. |

FOREIGN PATENT DOCUMENTS

| | | |
|---|---|---|
| CA | 2 019 559 | 12/1990 |
| EP | 0 368 684 | 9/2004 |
| WO | WO 93/11161 | 6/1993 |
| WO | WO 95/27062 | 10/1995 |
| WO | WO 97/45450 | 12/1997 |
| WO | WO 00/34337 | 6/2000 |
| WO | WO 2005/012359 | 2/2005 |
| WO | WO 2005/044853 | 5/2005 |

OTHER PUBLICATIONS

Rudikoff et al, Proc Natl Acad Sci USA 1982 vol. 79 p. 1979.*
Kobrin et al, J Immunology 146: 2017-2020, 1991.*
Barrios et al, J Molecular Recognition 17: 332-338, 2004.*
Adamis et al., "Inhibition of Vascular Endothelial Growth Factor Prevents Retinal Ischemia-Associated Iris Neovascularization in a Nonhuman Primate", *Arch Ophthalmol.*, 114:66-71 (1996).
Aiello et al., "Vascular Endothelial Growth Factor in Ocular Fluid of Patients with Diabetic Retinopathy and Other Retinal Disorders", *The New England Journal of Medicine*, 331:1480-1487 (1994).
Barbas et al., "In vitro evolution of a neutralizing human antibody to human immunodeficiency virus type 1 to enhance affinity and broaden strain cross-reactivity", *Proc. Natl. Acad. Sci. USA*, 91:3809-3813 (1994).
Barbas et al., "Selection and evolution of high-affinity human antiviral antibodies", *Tibtech*, 14:230-234 (1996).
Bass et al., "Hormone Phage: An Enrichment Method for Variant Proteins with Altered Binding Proteins", *Proteins: Structure, Function and Genetics*, 8:309-314 (1990).
Berkman et al., "Expression of the Vascular Permeability Factor/Vasculer Endothelial Growth Factor Gene in Central Nervous System Neoplasms", *J. Clin. Invest.*, 91:153-159 (1993).
Borgström et al., "Complete Inhibition of Angiogenesis and Growth of Microtumors by Anti-Vascular Endothelial Growth Factor Neutralizing Antibody: Novel Concepts of Angiostatic Therapy from Intravital Videomicroscopy", *Cancer Research*, 56:4032-4030 (1996).
Brekken et al., "Vascular Endothelial Growth Factor as a Marker of Tumor Endothelium", *Cancer Research*, 58:1952-1959 (1998).

(Continued)

*Primary Examiner*—Phuong Huynh
(74) *Attorney, Agent, or Firm*—Karen L. Elbing; Clark & Elbing LLP

(57) ABSTRACT

Anti-VEGF antibodies and variants thereof, including those having high affinity for binding to VEGF, are disclosed. Also provided are methods of using phage display technology with naïve libraries to generate and select the anti-VEGF antibodies with desired binding and other biological activities. Further contemplated are uses of the antibodies in research, diagnostic and therapeutic applications.

13 Claims, 50 Drawing Sheets

OTHER PUBLICATIONS

Brown et al., "Expression of Vascular Permeability Factor (Vascular Endothelial Growth Factor) and Its Receptors in Adenocarcinomas of the Gastrointestinal Tract", *Cancer Research*, 53:4727-4735 (1993).

Brown et al., "Expression of Vascular Permeability Factor (Vascular Endothelial Growth Factor) and its Receptors in Breast Cancer", *Hum Pathol.*, 26:86-91 (1995).

Carmeliet et al., "Angiogenesis in cancer and other diseases", *Nature*, 407:249-257 (2000).

Carmeliet et al., "Abnormal blood vessel development and lethality in embryos lacking a single VEGF allele", *Nature*, 380:435-439 (1996).

Carter et al., "High Level *Escherichia coli* Expression and Production of a Bivalent Humanized Antibody Fragment", *Bio/Technology*, 10:163-167 (1992).

Carter et al., "Humanization of an anti-p185$^{Her2}$ antibody for human cancer therapy", *Proc. Natl. Acad. Sci. USA*, 89:4285-4289 (1992).

Chen et al., "Selection and Analysis of an Optimized Anti-VEGF Antibody: Crystal Structure of an Affinity-matured Fab in Complex with Antigen", *J. Mol. Biol.*, 293:865-881 (1999).

Chothia et al., "Canonical Structures for the Hypervariable Regions of Immunoglobulins", *J. Mol. Biol.*, 196:901-917 (1987).

Christinger et al., "Crystallization of the Receptor Binding Domain of Vascular Endothelial Growth Factor", *Proteins: Structure, Function, and Genetics*, 26:353-357 (1996).

Clackson et al., "Making antibody fragments using phage display libraries", *Nature*, 352:624-628 (1991).

Cunningham et al., "High-Resolution Epitope Mapping of hGH-Receptor Interactions by Alanine-Scanning Mutagenesis", *Reports*, 244:1081-1085 (1989).

de Wildt et al., "Antibody arrays for high-throughput screening of antibody-antigen interactions", *Nature Biotechnology*, 18:989-994 (2000).

Deng et al., "Selection of Antibody Single-chain Variable Fragments with Improved Carbohydrate Binding by Phage Display", *The Journal of Biological Chemistry*, 269(13):9533-9538 (1994).

Deshayes et al., "Rapid Identification of Small Binding Motifs with High-Throughput Phage Display: Discovery of Peptidic Antagonists of IGF-1 Function", *Chemistry & Biology*, 9:495-505 (2002).

Dvorak et al., "Vascular Permeability Factor/Vascular Endothelial Growth Factor, Microvascular Hyperpermeability, and Angiogenesis", *American Journal of Pathology*, 146(5):1029-1039 (1995).

Ferrara et al., "Vascular endothelial growth factor is essential for corpus luteum angiogenesis", *Nature Medicine*, 4(3):336-340 (1998).

Ferrara et al., "Clinical applications of angiogenic growth factors and their inhibitors", *Nature Medicine*, 5(12):1359-1364 (1999).

Ferrara et al., "Molecular and Biological Properties of the Vascular Endothelial Growth Factor Family of Proteins", *Endocrine Reviews*, 13(1):18-32 (1992).

Ferrara et al., "The Biology of Vascular Endothelial Growth Factor", *Endocrine Reviews*, 18(1):4-25 (1997).

Ferrara, "Molecular and biological properties of vascular endothelial growth factor", *J. Mol. Med.*, 77:527-543 (1999).

Ferrara et al., "Heterozygous embryonic lethality induced by targeted inactivation of the VEGF gene", *Nature*, 380:439-442 (1996).

Folkman et al., "Angiogenic Factors", *Science*, 235(4787):442-447 (1987).

Garrard et al., "Selection of an anti-IGF-1 Fab from a Fab phage library created by mutagenesis of multiple CDR loops", *Gene*, 128:103-109 (1993).

Gerber et al., "VEGF couples hypertrophic cartilage remodeling, ossification and angiogenesis during endochondral bone formation", *Nature Medicine*, 5(6):623-628 (1999).

Griffiths et al., "Isolation of high affinity human antibodies directly from large synthetic repertoires", *The EMBO Journal*, 13(14):3245-3260 (1994).

Guerrin et al., "Vasculotropin/Vascular Endothelial Growth Factor is an Autocrine Growth Factor for Human Retinal Pigment Epithelial Cells Cultured in Vitro", *Journal of Cellular Physiology*, 164:385-394 (1995).

"Guidelines for the Management of Rheumatoid Arthritis", *Arthritis & Rheumatism*, 46(2):328-346 (2002).

Hawkins et al., "Selection of Phage Antibodies by Binding Affinity", *J. Mol. Biol.*, 226:889-896 (1992).

Holliger et al., "Diabodies: Small bivalent and bispecific antibody fragments", *Proc. Natl. Acad. Sci. USA*, 90:6444-6448 (1993).

Hoogenboom et al., "Antibody phage display technology and its applications", *Immunotechnology*, 4:1-20 (1998).

Houck et al., "The Vascular Endothelial Growth Factor Family: Identification of a Fourth Molecular Species and Characterization of Alternative Splicing of RNA", *Molecular Endocrinology*, 5:1806-1814 (1991).

Jackson et al., "In Vitro Antibody Maturation: Improvement of a High Affinity, Neutralizing Antibody Against IL-1β", *The Journal of Immunology*, 154:3310-3319 (1995).

Jones et al., "Replacing the complementarity-determining regions in a human antibody with those from a mouse", *Nature*, 321:522-525 (1986).

Kim et al., "The Vascular Endothelial Growth Factor Proteins: Identification of Biologically Relevant Regions by Neutralizing Monoclonal Antibodies", *Growth Factors*, 7:53-64 (1992).

Kim et al., "Inhibition of vascular endothelial growth factor-induced angiogenesis suppresses tumour growth in vivo", *Nature*, 362:841-844 (1993).

Klagsbrun et al., "Regulators of Angiogenesis", *Annu. Rev. Physiol.*, 53:217-239 (1991).

Klohs et al., "Antiangiogenic agents", *Current Opinion in Biotechnology*, 10:544-549 (1999).

Knappik et al., "Fully Synthetic Human Combinatorial Antibody Libraries (HuCAL) Based on Modular Consensus Frameworks and CDRs Randomized with Trinucleotides", *J. Mol. Biol.*, 296:57-86 (2000).

Leung et al., "Vascular Growth Factor is a Secreted Angiogenic Mitogen", *Science*, 246:1306-1309 (1989).

Lowman et al., "Selecting High-Affinity Binding Proteins by Monovalent Phage Display", *Biochemistry*, 30:10832-10838 (1991).

Lowman et al., "Monovalent Phage Display: A Method for Selecting Variant Proteins from Random Libraries", *Methods: A Companion to Methods in Enzymology*, 3(3):205-216 (1991).

Marks et al., "By-passing Immunization Human Antibodies from V-gene Libraries Displayed on Phage", *J. Mol. Biol.*, 222:581-597 (1991).

Mattern et al., "Association of vascular endothelial growth factor expression with intratumoral microvessel density and tumour cell proliferation in human epidermoid lung carcinoma", *British Journal of Cancer*, 73:931-934 (1996).

Melnyk et al., "Vascular Endothelial Growth Factor Promotes Tumor Dissemination by a Mechanism Distinct from Its Effect on Primary Tumor Growth", *Cancer Research*, 56:921-924 (1996).

Mian et al., "Structure, Function and Properties of Antibody Binding Sites", *J. Mol. Biol.*, 217:133-151 (1991).

Morrison et al., "Chimeric human antibody molecules: Mouse antigen-binding domains with human constant region domains", *Proc. Natl. Acad. Sci. USA*, 81:6851-6855 (1984).

Morrison et al., "Combinatorial alanine-scanning", *Current Opinion in Chemical Biology*, 5:302-307 (2001).

Muller et al., "Vascular endothelial growth factor: Crystal structure and functional mapping of the kinase domain receptor binding site", *Proc. Natl. Acad. Sci. USA*, 94:7192-7197 (1997).

Muller et al., "VEGF and the Fab fragment of a humanized neutralizing antibody: crystal structure of the complex at 2.4 Å resolution and mutational analysis of the interface", *Structure*, 6:1153-1167(1998).

Öberg-Walsh et al., "Effects of vascular endothelial growth factor on pancreatic duct cell replication and the insulin production of fetal islet-like cell clusters in vitro", *Molecular and Cellular Endocrinology*, 126:125-132 (1997).

Plückthun, "Antibodies from *Escherichia coli*", *The Pharmacology of Monoclonal Antibodies*, Springer-Verlag, Ch. 11, pp. 269-315 (1994).

Popkov et al., "Rabbit Immune Repertoires as Sources for Therapeutic Monoclonal Antibodies: The Impact of Kappa Allotype-correlated Variation in Cysteine Content on Antibody Libraries Selected by Phage Display", *J. Mol. Biol.*, 325:325-335 (2003).

Presta, "Antibody engineering", *Current Opinion in Biotechnology*, 2:593-596 (1992).

Presta et al., "Humanization of an Anti-Vascular Endothelial Growth Factor Monoclonal Antibody for the Therapy of Solid Tumors and Other Disorders", *Cancer Research*, 57:4593-4599 (1997).

Rai et al., "Chronic Lymphocytic Leukemia", *Hematology:Basic Principles and Practice*, 3rd Edition, Ch. 72, pp. 1350 (2000).

Riechmann et al., "Reshaping human antibodies for therapy", *Nature*, 332:323-327 (1988).

Sato, "Molecular diagnosis of tumor angiogenesis and anti-angiogenic cancer therapy", *Int. J. Clin. Oncol.*, 8:200-206 (2003).

Sidhu et al., "Phage Display for Selection of Novel Binding Peptides", *Methods in Enzymology*, 328:333-363 (2000).

Sidhu et al., "Phage-displayed Antibody Libraries of Synthetic Heavy Chain Complementarity Determining Regions", *J. Mol. Biol.*, 338:299-310 (2004).

Siemeister et al., "The pivotal role of VEGF in tumor angiogenesis: Molecular facts and therapeutic opportunities", *Cancer and Metastasis Reviews*, 17:241-248 (1998).

Stella et al., "Prodrugs: A Chemical Approach to Targeted Drug Delivery", *Directed Drug Delivery: A Multidisciplinary Problem*, The Humana Press, Clifton, New Jersey, pp. 247-267 (1985).

Streit et al., "Angiogenesis, lymphangiogenesis, and melanoma metastasis", *Oncogene*, 22:3172-3179 (2003).

Tonini et al., "Molecular basis of angiogenesis and cancer", *Oncogene*, 22:6549-6556 (2003).

van Besien et al., "Clinical Manifestations, Staging, and Treatment of Non-Hodgkin Lymphoma", *Hematology: Basic Principles and Practice*, 3rd Edition, Churchill Livinstone, pp. 1293-1339 (2000).

Vaughan et al., "Human Antibodies with Sub-nanomolar Affinities Isolated from a Large Non-immunized Phage Display Library", *Nature Biotechnology*, 14:309-314 (1996).

Verhoeyen et al., "Reshaping Human Antibodies: Grafting an Antilysozyme Activity", *Science*, 239:1534-1536 (1988).

Warren et al., "Regulation by Vascular Endothelial Growth Factor of Human Colon Cancer Tumorigenesis in a Mouse Model of Experimental Liver Metastasis", *J. Clin. Invest.*, 95:1789-1797 (1995).

Wells et al., "Rapid evolution of peptide and protein binding properties in vitro", *Current Opinion in Biotechnology*, 3:355-362 (1992).

Wilman, "Prodrugs in cancer chemotherapy", *Biochemical Society Transactions*, 14(2):375-382 (1986).

Yelton et al., "Affinity Maturation of the BR96 Anti-Carcinoma Antibody by Codon-Based Mutagenesis", *The Journal of Immunology*, 155:1994-2994 (1995).

Zapata et al., "Engineering linear F(ab')$_2$ fragments for efficient production in *Escherichia coli* and enhanced antiproliferative activity", *Protein Engineering*, 8(10):1057-1062 (1995).

Zemlin et al., "Expressed Murine and Human CDR-H3 Intervals of Equal Length Exhibit Distinct Repertoires that Differ in their Amino Acid Composition and Predicted Range of Structures", *J. Mol. Biol.*, 334:733-749 (2003).

Zola, "Using Monoclonal Antibodies: Soluble Antigens", *Monoclonal Antibodies: A Manual of Techniques*, CRC Press, Inc., Boca Raton, Florida, Ch. 6, pp. 147-181 (2000).

Beiboer et al., "Guided Selection of a Pan Carcinoma Specific Antibody Reveals Similar Binding Characteristics Yet Structural Divergence Between the Original Murine Antibody and Its Human Equivalent," *J. Mol. Biol.* 296: 833-849 (2000).

Fuh et al., "Structure-Function Studies of Two Synthetic Anti-Vascular Endothelial Growth Factor Fabs and Comparison with the Avastin™ Fab," *J. Biol. Chem.* 281: 6625-6631 (2006).

Liang et al., "Cross-Species Vascular Endothelial Growth Factor (VEGF)-Blocking Antibodies Completely Inhibit the Growth of Human Tumor Xenografts and Measure the Contribution of Stromal VEGF," *J. Biol. Chem.* 281: 951-961 (2006).

Lowman, "Optimization of Therapeutic Antibodies Using Monovalent Phage Display," *Presentation for Bio 2002 Conference*, Jun. 12, 2002.

Sone et al., "Neutralization of Vascular Endothelial Growth Factor Prevents Collagen-Induced Arthritis and Ameliorates Established Disease in Mice," *Biochem. Biophys. Res. Commun.* 281: 562-568 (2001).

\* cited by examiner

FIG. 2

| Clone | H1 | | | | H2 | | | | | | H3 | | | | | | | | IC50 (nM) | |
|---|---|---|---|---|---|---|---|---|---|---|---|---|---|---|---|---|---|---|---|---|
| | 30 | 31 | 32 | 33 | 49 | 50 | 52 | 53 | 54 | 56 | 58 | 95 | 96 | 97 | 98 | 99 | 100 | 100a | mVEGF | hVEGF |
| h4D5 | K | D | T | Y | A | R | Y | T | N | Y | R | W | G | G | D | G | F | Y | ND | ND |
| G6 | S | D | Y | W | A | G | T | A | G | Y | Y | F | V | F | F | L | P | Y | 0.6 | 1.4 |
| B20 | N | A | S | W | G | A | Y | Y | S | Y | N | W | G | H | S | T | S | W | 22 | 159 |
| B29 | T | G | S | G | G | W | Y | Y | S | N | Y | A | L | W | A | F | V | A | 25 | >2000 |
| C3 | T | G | S | S | A | R | S | A | G | Y | D | Y | F | R | W | Y | M | A | 80 | 696 |

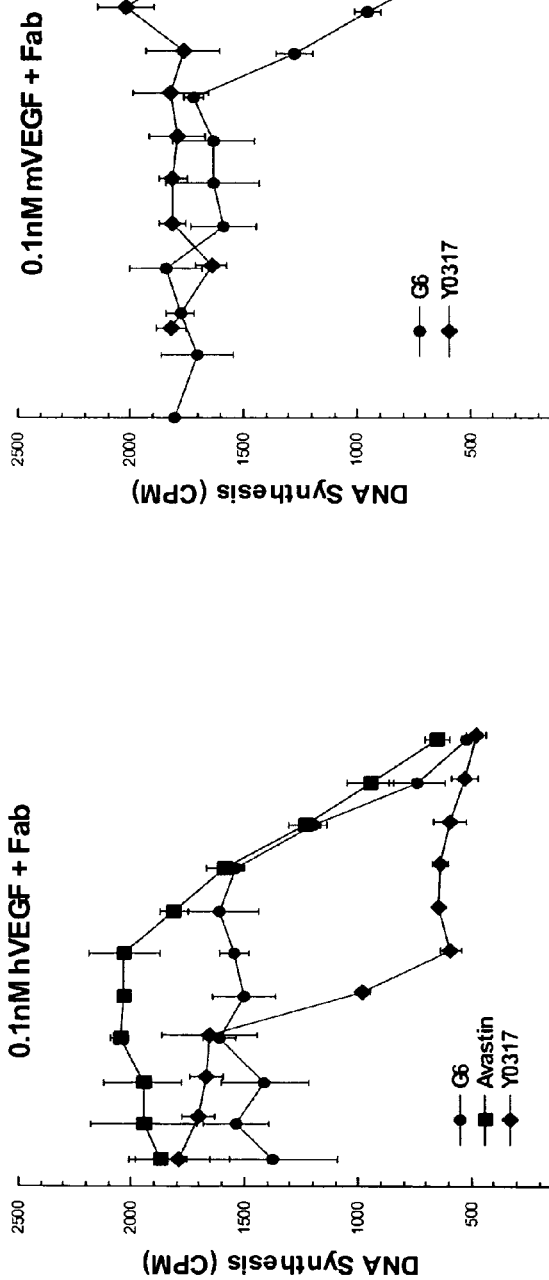
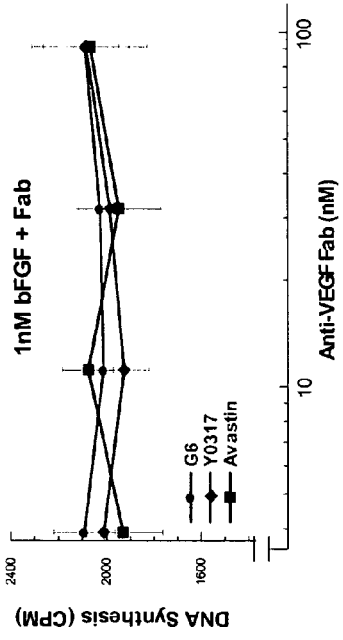
FIG. 6B
FIG. 6C
FIG. 6A

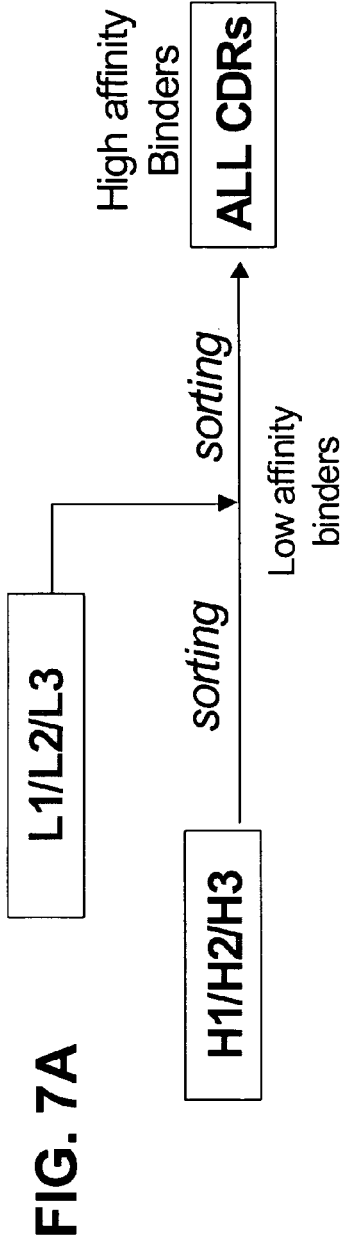

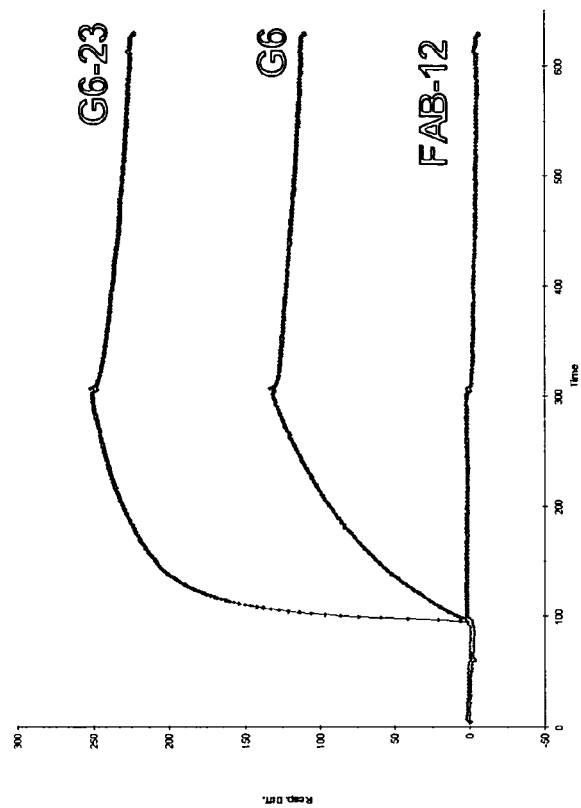
FIG. 8A  hVEGF
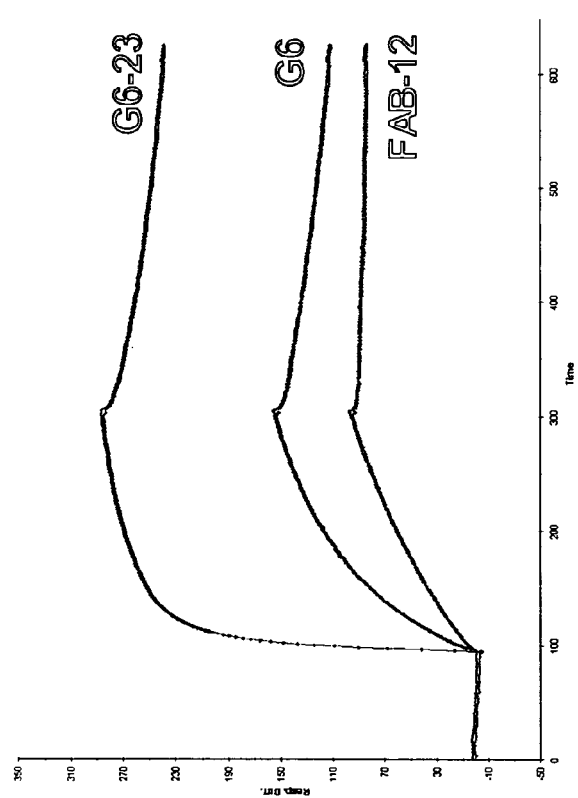
FIG. 8B  mVEGF
FIG. 8C
|  | $k_{on}/10^4$ | | $k_{off}/10^{-4}$ | | Kd (nM) | |
| --- | --- | --- | --- | --- | --- | --- |
|  | hVEGF | mVEGF | hVEGF | mVEGF | hVEGF | mVEGF |
| G6 | 15.2 | 19.3 | 2.5 | 1.3 | 1.6 | 0.7 |
| G6-23 | 126 | 114 | 2.6 | 1.3 | <0.2 | <0.1 |
| Avastin | 4.1 | NB | 1.2 | NB | 2.9 | NB |

| | Wild-type | G6 & G6-23 HC Shotgun Scan Codon | | | | Homolog-scan | | |
|---|---|---|---|---|---|---|---|---|
| | | Alanine-scan | | | | | | |
| | | Codon | m1 | m2 | m3 | Codon | m4 | m5 |
| CDR-H1 | *S30 | KCC | A | | | KCC | A | |
| | D31 | GMT | A | | | GAM | E | |
| | Y32 | KMT | A | D | S | TWC | F | |
| | W33 | KSG | A | G | S | YKG | L | R |
| CDR-H2 | *G50 | GST | A | | | GST | A | |
| | I51 | RCT | | | | RTT | V | |
| | T52 | RCT | A | | | ASC | S | |
| | P52a | | | | | SCA | A | |
| | A53 | GST | G | | | KCT | S | |
| | *G54 | GST | A | | | GST | A | |
| | G55 | | | | | GST | A | |
| | Y56 | KMT | A | D | S | TWC | F | |
| | T57 | | | | | ASC | S | |
| | Y58 | KMT | A | D | S | TWC | F | |
| CDR-H3 | F95 | KYT | A | | V | TWC | Y | |
| | V96 | GYT | A | | | RTT | I | |
| | F97 | KYT | A | S | V | TWC | Y | |
| | F98 | KYT | A | S | V | TWC | Y | |
| | L99 | SYT | A | P | V | MTC | I | |
| | *P100 | SCA | A | | | SCA | A | |
| | Y100a | KMT | A | D | S | TWC | F | |

G6 & G6-23 LC Shotgun Scan Codons

| | Wild-type | Alanine-scan | | | | Homolog-scan | | |
|---|---|---|---|---|---|---|---|---|
| | | Codon | m1 | m2 | m3 | Codon | m4 | m5 |
| CDR-L1 | *Q27 | SMA | A | E | P | SAA | E | |
| | D28 | GMT | A | | | GAM | E | |
| | V29 | GYT | A | | | RTT | I | |
| | *S30 | KCC | A | | | KCC | A | |
| | T31 | RCT | A | | | ASC | S | |
| | A32 | GST | G | | | KCT | S | |
| CDR-L2 | Y49 | KMT | A | D | S | TWC | F | |
| | *S50 | KCC | A | | | KCC | A | |
| | F53 | KYT | A | S | V | TWC | Y | |
| | Y55 | KMT | A | D | S | TWC | F | |
| CDR-L3 | *Q89K | SMA/RMA | A/A | E/E | P/T | VAR | E/E | K/Q |
| | Q90 | | | | | VAR | E | K |
| | *S91G | KCC/GST | A/A | | S | KCC | A/A | |
| | Y92 | KMT | A | D | | TWC | F | |
| | T93A | RCT/GST | A/G | D | T | ASC | S/S | |
| | *T94N | RCT | A/A | G | S | ASC | S/D | |
| | *P96W | SCA/KSG | A/A | | | SCA | A/L | |

FIG. 15

| Library | Mutated CDR residues | Mutagenic oligos | Diversity | |
|---|---|---|---|---|
| | | | Theoretical | Actual |
| Alanine-scan | | | | |
| hcA-G6 hcA-G6-23 | CDR-H1: S30, D31, Y32, W33<br>CDR-H2: G50, T52, A53, G54, Y56, Y58<br>CDR-H3: F95, V96, F97, F98, L99, P100, Y100a | H1-A<br>H2-A<br>H3-A | 6.7E+07 | 2.1E+09 |
| lcA-G6 | CDR-L1: Q27, D28, V29, S30, T31, A32<br>CDR-L2: Y49, S50, F53, Y55<br>CDR-L3: Q89, S91, Y92, T93, T94, P96 | L1-A<br>L2-A<br>L3-A1 | 4.2E+06 | 4.8E+09 |
| lcA-G6-23 | CDR-L1: Q27, D28, V29, S30, T31, A32<br>CDR-L2: Y49, S50, F53, Y55<br>CDR-L3: K89, G91, Y92, A93, N94, W96 | L1-A<br>L2-A<br>L3-A2 | 8.3E+06 | 4.5E+09 |
| Homolog-scan | | | | |
| hcH-G6 hcH-G6-23 | CDR-H1: S30, D31, Y32, W33<br>CDR-H2: G50, I51, T52, P52a, A53, G54, G55, Y56, T57, Y58<br>CDR-H3: F95, V96, F97, F98, L99, P100, Y100a | H1-H<br>H2-H<br>H3-H | 3.1E+06 | 2.3E+09 |
| lcH-G6 | CDR-L1: Q27, D28, V29, S30, T31, A32<br>CDR-L2: Y49, S50, F53, Y55<br>CDR-L3: Q89, Q90, S91, Y92, T93, T94, P96 | L1-H<br>L2-H<br>L3-H1 | 2.9E+05 | 4.5E+09 |
| lcH-G6-23 | CDR-L1: Q27, D28, V29, S30, T31, A32<br>CDR-L2: Y49, S50, F53, Y55<br>CDR-L3: K89, Q90, G91, Y92, A93, N94, P96 | L1-H<br>L2-H<br>L3-H2 | 2.9E+05 | 5.3E+09 |

FIG. 16(A)

G6 Fab heavy chain shotgun scan

| | Residue | Target selection (VEGF) | | | | | Display selection (Anti-gD tag) | | | | | $F_{wt/mut}$ | | | | |
|---|---|---|---|---|---|---|---|---|---|---|---|---|---|---|---|---|
| | | Alanine-scan | | | Homolog-scan | | Alanine-scan | | | Homolog-scan | | Alanine-scan | | | Homolog-scan | |
| | | Wt/m1 | Wt/m2 | Wt/m3 | Wt/m4 | Wt/m5 | Wt/m1 | Wt/m2 | Wt/m3 | Wt/m4 | Wt/m5 | m1 | m2 | m3 | m4 | m5 |
| CDR-H1 | S30 | 1.55 | | | 2.47 | | 1.63 | | | 3 | | 0.9 | | | 0.9 | |
| | D31 | 3.46 | | | 2.47 | | 0.96 | | | 2.08 | | 3.6 | | | 1.2 | |
| | Y32 | 52 | >104 | 104.0 | 0.61 | | 1.70 | 1.62 | 1.03 | 0.88 | | 30.6 | >64.2 | 100.9 | 0.7 | |
| | W33 | 103 | 103 | 51.5 | 54.5 | >109 | 1.14 | 1.09 | 0.66 | 0.34 | 1.1 | 90.6 | 94.8 | 78.3 | 159.1 | >95.9 |
| CDR-H2 | G50 | 53 | | | >111 | | 1.45 | | | 1 | | 36.1 | | | >93.9 | |
| | I51 | | | | 0.12 | | | | | 0.62 | | | | | 0.2 | |
| | T52 | 52.50 | | | 54.5 | | 1.20 | | | 0.50 | | 43.6 | | | 109.0 | |
| | P52a | | | | 2 | | | | | 1.55 | | | | | 1.3 | |
| | A53 | 3.65 | | | 1.27 | | 1 | | | 0.64 | | 3.8 | | | 2.0 | |
| | G54 | 11 | | | 54.5 | | 1.04 | | | 1.50 | | 10.5 | | | 36.3 | |
| | G55 | | | | 36 | | | | | 2.16 | | | | | 16.7 | |
| | Y56 | 3.06 | 6 | 1.79 | 0.91 | | 0.57 | 0.74 | 0.45 | 1 | | 5.4 | 7.8 | 4.0 | 0.8 | |
| | T57 | | | | 0.56 | | | | | 0.76 | | | | | 0.7 | |
| | Y58 | 0.05 | 0.02 | 0.02 | 1.02 | | 0.93 | 1.13 | 0.84 | 1.31 | | 0.05 | 0.02 | 0.03 | 0.8 | |
| CDR-H3 | F95 | >104 | >104 | 35 | 3.11 | | 5 | 1.69 | 69 | 1.55 | | >21.2 | >61.6 | 0.5 | 2.0 | |
| | V96 | 26 | | | >111 | | 2.18 | | | 1.86 | | 11.8 | | | >59.8 | |
| | F97 | 105 | 105.00 | >71 | >111 | | 3 | 1.6 | 1.8 | 2.24 | | 37.5 | 67.5 | >40.6 | >49.5 | |
| | F98 | 106.00 | >106 | >106 | 17.5 | | 2.79 | 1.34 | 1.50 | 2.64 | | 38.1 | >79 | >71 | 6.6 | |
| | L99 | 52 | >104 | 104.00 | >111 | | 0.75 | 4.0 | 0.52 | 1.67 | | 69.3 | >26 | 199.3 | >66.6 | |
| | P100 | 8 | | | >111 | | 0.89 | | | 3.62 | | 8.8 | | | >30.7 | |
| | Y100a | 89 | 89.00 | 5.56 | 1.71 | | 1.19 | 1.92 | 0.51 | 0.48 | | 74.8 | 46.3 | 10.9 | 3.5 | |

FIG. 16(B)

G6-23 Fab heavy chain shotgun scan

| | | Target selection (VEGF) | | | | Display selection (Anti-gD tag) | | | | | $F_{wt/mut}$ | | | | |
|---|---|---|---|---|---|---|---|---|---|---|---|---|---|---|---|
| | | Alanine-scan | | | Homolog-scan | | Alanine-scan | | | Homolog-scan | | Alanine-scan | | | Homolog-scan |
| | Residue | Wt/m1 | Wt/m2 | Wt/m3 | Wt/m4 | Wt/m5 | Wt/m1 | Wt/m2 | Wt/m3 | Wt/m4 | Wt/m5 | m1 | m2 | m3 | m4 | m5 |
| CDR-H1 | S30 | 2.54 | | | 2.29 | | 1.55 | | | 4 | | 1.6 | | | 0.6 | |
| | D31 | 2.44 | | | 2.75 | | 0.67 | | | 2.59 | | 3.7 | | | 1.1 | |
| | Y32 | 16 | >113 | 28.3 | 0.78 | | 1.29 | 1.64 | 0.82 | 0.82 | | 12.6 | >69.1 | 34.5 | 0.9 | |
| | W33 | >123 | >123 | 123 | 1.5 | >81 | 1.21 | 1.43 | 1.38 | 0.64 | 1.5 | >101.5 | >86.1 | 89.2 | 2.3 | >53.3 |
| CDR-H2 | G50 | >124 | | | >135 | | 0.94 | | | 2 | | >132 | | | >54.3 | |
| | I51 | | | | 0.61 | | | | | 0.82 | | | | | 0.7 | |
| | T52 | 40.33 | | | 4.6 | | 1.00 | | | 0.56 | | 44.3 | | | 8.2 | |
| | P52a | | | | 44 | | | | | 1.98 | | | | | 22.3 | |
| | A53 | 5.53 | | | 0.47 | | 1 | | | 0.56 | | 5.4 | | | 0.8 | |
| | G54 | 7 | | | 32.8 | | 0.69 | | | 2.13 | | 10.6 | | | 15.4 | |
| | G55 | | | | 7 | | | | | 2.21 | | | | | 3.1 | |
| | Y56 | 2.55 | 4 | 1.31 | 0.78 | | 1.27 | 1.73 | 0.95 | 1 | | 2.0 | 2.1 | 1.4 | 1.1 | |
| | T57 | | | | 1.01 | | | | | 0.77 | | | | | 1.3 | |
| | Y58 | 0.89 | 1.79 | 0.44 | 1.70 | | 1.45 | 0.91 | 0.59 | 1.22 | | 0.84 | 2.34 | 0.93 | 1.4 | |
| CDR-H3 | F95 | >118 | >118 | 20 | 3.82 | | 4 | 2.50 | 3 | 1.98 | | >30.9 | >47.2 | 6.7 | 1.9 | |
| | V96 | 9 | | | 14.00 | | 1.95 | | | 1.98 | | 4.4 | | | 7.1 | |
| | F97 | >123 | >123 | 123.00 | 66.50 | | 4 | 1.3 | 1.9 | 1.39 | | >33.8 | >91.7 | 65.1 | 47.8 | |
| | F98 | >123 | 123.00 | >123 | 6.5 | | 3.47 | 2.11 | 2.27 | 2.05 | | >35.4 | 58.4 | >54.2 | 3.2 | |
| | L99 | 4 | 44.00 | 9.78 | 15.88 | | 1.40 | 2.1 | 0.66 | 1.65 | | 2.5 | 21.4 | 14.8 | 9.6 | |
| | P100 | 2 | | | 6.94 | | 0.73 | | | 2.21 | | 2.5 | | | 3.1 | |
| | Y100a | 27 | >109 | 9.91 | 2.14 | | 1.36 | 2.24 | 0.81 | 1.14 | | 20.1 | >48.8 | 12.3 | 1.9 | |

FIG. 17(A)

G6 Fab light chain shotgun scan

| | | Target selection (VEGF) | | | | Display selection (Anti-gD tag) | | | | | $F_{wt/mut}$ | | | | |
|---|---|---|---|---|---|---|---|---|---|---|---|---|---|---|---|
| | | Alanine-scan | | Homolog- | | Alanine-scan | | | Homolog- | | Alanine-scan | | | Homolog- | |
| Residue | Wt/m1 | Wt/m2 | Wt/m3 | Wt/m4 | Wt/m5 | Wt/m1 | Wt/m2 | Wt/m3 | Wt/m4 | Wt/m5 | m1 | m2 | m3 | m4 | m5 |
| CDR-L1 | | | | | | | | | | | | | | | |
| Q27 | 1.24 | 1.9 | 0.8 | 1.58 | | 0.88 | 1.75 | 0.93 | 2.00 | | 1.4 | 1.1 | 0.9 | 0.8 | |
| D28 | 0.61 | | | 0.97 | | 0.49 | | | 1.52 | | 1.2 | | | 0.6 | |
| V29 | 2 | | | 1.76 | | 2.42 | | | 1.22 | | 0.8 | | | 1.4 | |
| S30 | 2 | | | 1.2 | | 1.59 | | | 1.06 | | 1.0 | | | 1.2 | |
| T31 | 1 | | | 0.9 | | 0.66 | | | 0.88 | | 1.0 | | | 1.1 | |
| A32 | 2 | | | 1.83 | | 1.72 | | | 1.85 | | 1.0 | | | 1.0 | |
| CDR-L2 | | | | | | | | | | | | | | | |
| Y49 | 9.78 | 88.00 | 6.77 | 1.83 | | 0.92 | 2.40 | 0.52 | 0.98 | | 10.6 | 36.7 | 13.0 | 1.9 | |
| S50 | 1.467 | | | 0.90 | | 1.16 | | | 1.41 | | 1.3 | | | 0.6 | |
| F53 | 4.92 | 2.03 | 5.36 | 1.47 | | 2.53 | 2.15 | 1.65 | 1.13 | | 1.9 | 0.9 | 3.2 | 1.3 | |
| Y55 | 0.97 | 11 | 0.87 | 3.30 | | 0.88 | 3.50 | 0.74 | 1.41 | | 1.1 | 3.2 | 1.2 | 2.3 | |
| CDR-L3 | | | | | | | | | | | | | | | |
| Q89 | 0.57 | 2 | 16.50 | 1.50 | 2.71 | 0.96 | 4.78 | 4.78 | 2.63 | 5.46 | 0.6 | 0.4 | 3.5 | 0.6 | 0.5 |
| Q90 | | | | 0.98 | 3.92 | | | | 1.47 | 1.47 | | | | 0.7 | 2.7 |
| S91 | 0.98 | | | 0.41 | | 1.41 | | | 0.91 | | 0.7 | | | 0.5 | |
| Y92 | 1.17 | 17.50 | 0.80 | 0.40 | | 1.00 | 3.00 | 1.14 | 0.59 | | 1.2 | 5.8 | 0.7 | 0.7 | |
| T93 | 0.48 | | | 1.42 | | 0.45 | | | 0.71 | | 1.06 | | | 2.0 | |
| T94 | 1 | | | 0.73 | | 0.89 | | | 0.68 | | 0.56 | | | 1.1 | |
| P96 | 5 | | | 3.64 | | 2.66 | | | 4.55 | | 1.7 | | | 0.8 | |

FIG. 17(B)

G6-23 Fab light chain shotgun scan

| | | Target selection (VEGF) | | | | Display selection (Anti-gD tag) | | | | $F_{wt/mut}$ | | | | |
|---|---|---|---|---|---|---|---|---|---|---|---|---|---|---|
| | | Alanine-scan | | | Homolog- | Alanine-scan | | | Homolog- | Alanine-scan | | | Homolog- | |
| | Residue | Wt/m1 | Wt/m2 | Wt/m3 | Wt/m4 | Wt/m5 | Wt/m1 | Wt/m2 | Wt/m3 | Wt/m4 | Wt/m5 | m1 | m2 | m3 | m4 | m5 |
| CDR-L1 | Q27 | 1.75 | 2.69 | 1.03 | 1.00 | | 1.24 | 1.63 | 0.76 | 1.76 | | 1.41 | 1.66 | 1.35 | 0.57 | |
| | D28 | 0.62 | | | 1.18 | | 0.64 | | | 1.37 | | 0.96 | | | 0.86 | |
| | V29 | 1.76 | | | 1.65 | | 2.23 | | | 0.82 | | 0.79 | | | 2.01 | |
| | S30 | 2.29 | | | 1.18 | | 2.46 | | | 1.00 | | 0.93 | | | 1.18 | |
| | T31 | 0.65 | | | 1.09 | | 0.90 | | | 1.04 | | 0.72 | | | 1.04 | |
| | A32 | 2.00 | | | 1.72 | | 2.23 | | | 1.49 | | 0.90 | | | 1.16 | |
| CDR-L2 | Y49 | 13.17 | 19.75 | 6.08 | 3.26 | | 2.11 | 9.50 | 1.03 | 2.00 | | 6.24 | 2.08 | 5.92 | 1.63 | |
| | S50 | 1.49 | | | 1.58 | | 1.62 | | | 1.37 | | 0.92 | | | 1.15 | |
| | F53 | 3.53 | 2.94 | 3.31 | 0.92 | | 4.67 | 1.68 | 2.00 | 1.08 | | 0.76 | 1.75 | 1.66 | 0.85 | |
| | Y55 | 0.94 | 7.75 | 0.91 | 2.63 | | 0.76 | 8.67 | 0.76 | 1.83 | | 1.23 | 0.89 | 1.19 | 1.43 | |
| CDR-L3 | K89 | 0.05 | 0.31 | 2.00 | 0.82 | 0.21 | 0.07 | 0.45 | 0.71 | 0.39 | 0.13 | 0.71 | 0.68 | 2.80 | 2.10 | 1.63 |
| | Q90 | | | | 1.80 | 3.86 | | | | 2.48 | 8.38 | | | | 0.73 | 0.46 |
| | G91 | 0.55 | | | 0.92 | | 0.43 | | | 0.82 | | 1.28 | | | 1.12 | |
| | Y92 | 1.95 | 20.50 | 1.08 | 0.36 | | 1.19 | 3.57 | 0.57 | 0.48 | | 1.64 | 5.74 | 1.90 | 0.76 | |
| | A93 | 2.19 | | | 0.78 | | 1.49 | | | 0.55 | | 1.47 | | | 1.43 | |
| | N94 | 0.11 | 0.44 | 0.47 | 1.28 | | 0.09 | 0.42 | 0.23 | 0.79 | | 1.27 | 1.05 | 2.05 | 1.62 | |
| | W96 | 0.31 | 1.10 | 0.24 | 0.21 | | 2.29 | 12.00 | 2.00 | 0.57 | | 0.13 | 0.09 | 0.12 | 0.37 | |

| Origin | CDR | Mutants | Conventional scanning | | Shotgun scanning | |
|---|---|---|---|---|---|---|
| | | | $IC_{50,mut}/IC_{50,wt}$ | $\Delta G_{mut-wt}$ (kcal/mo) | $F_{wt/mut}$ | $\Delta G_{mut-wt}$ (kcal/mo) |
| FabG6 | H1 | W33A | >400 | >3.55 | 90.6 | 2.67 |
| | H2 | G50A | >400 | >3.55 | 36.1 | 2.12 |
| | | I51V | 0.08 | -1.5 | 0.2 | -1.0 |
| | | T52A | 113.6±24.7 | 2.8±1.9 | 43.6 | 2.2 |
| | | P52aA | 1.9 | 0.38 | 1.3 | 0.2 |
| | | G54A | 20.8±4.3 | 1.8±0.86 | 10.5 | 1.4 |
| | | Y58A | 0.14 | -1.2 | 0.05 | -1.8 |
| | H3 | V96A | >400 | >3.55 | 11.8 | 1.46 |
| | | V96I | 25.8±5.1 | 1.92±0.96 | >59.8 | >2.42 |
| | | F97A | >400 | >3.55 | 37.5 | 2.15 |
| | | F97Y | >400 | >3.55 | >49.5 | >2.31 |
| | | L99A | >400 | >3.55 | 69.3 | 2.51 |
| | | P100A | >400 | >3.55 | 8.8 | 1.29 |
| FabG6-23 | H1 | W33A | >5000 | >5.04 | >101.5 | >2.74 |
| | H2 | G50A | >5000 | >5.04 | >132 | >2.89 |
| | | I51V | 0.96 | -0.02 | 0.7 | -0.21 |
| | | T52A | 243±28 | 3.25±1.97 | 44.3 | 2.24 |
| | | P52aA | 711±113 | 3.9±2.8 | 22.3 | 1.84 |
| | | G54A | 44±3 | 2.24±0.65 | 10.5 | 1.39 |
| | | Y58A | 0.7 | -0.21 | 0.6 | -0.30 |
| | H3 | V96A | 95±9 | 2.7±1.3 | 4.4 | 0.88 |
| | | V96I | 14.6±0.8 | 1.59±0.13 | 7.1 | 1.16 |
| | | F97A | >5000 | >5.04 | >33.8 | >2.08 |
| | | F97Y | 725±74 | 3.9±2.5 | 47.8 | 2.29 |
| | | L99A | 9.6±0.4 | 1.34±0.54 | 2.5 | 0.54 |
| | | P100A | 13±0.6 | 1.5±0.3 | 2.5 | 0.54 |

| VEGF residue alanine scan | Relative affinity (IC50mut/IC50wt) | | | | | | |
|---|---|---|---|---|---|---|---|
| | G6 Fab | G6-23 Fab | B20-4 | *A4.6.1 | *Flt-1(1-3) | *Flt-1D2 | *KDR-IgG |
| 20s helix | | | | | | | |
| WT | 1.0 | 1.0 | 1.0 | 1.0 | 1 | 1 | 1.0 |
| V14A | 1.1 | 1.4 | 1.2 | 1.5 | | | 1.8 |
| K16A | 1.1 | 1.7 | 0.8 | 1.2 | 1 | 2 | 1.1 |
| F17A | NB | NB | >100 | 0.8 | 34 | 45 | NB |
| M18A | 4.4±0.5 | 4.1±0.4 | >100 | 1.2 | 9 | 56 | 5.0 |
| D19A | 1 | 0.9 | >100 | 0.7 | 0.8 | 1 | 0.6 |
| Y21A | 32.6±4.3 | 1840±720 | >100 | 2.6 | 29 | 123 | 2.8 |
| Q22A | 7.2±0.4 | 8.9±0.4 | 0.5 | 1.4 | 15 | 11 | 2.2 |
| Y25A | 20.5±2.9 | 131.5±15.2 | >100 | 1.2 | 7 | 17 | 1.7 |
| 40s loop | | | | | | | |
| I43A | 1 | 1.6 | 1.2 | 1.2 | 3 | | 5.6 |
| Y45A | 3.7±0.2 | 1.8 | 1.1 | 2.2 | | 4 | 1.6 |
| I46A | 2.2 | 1.7 | 1.3 | 2.1 | 4 | 3 | NB |
| F47A | 3.5±0.2 | 2.8 | 1.8 | NB | 3 | 1 | 3.6 |
| K48A | 0.3 | 1.5 | 1 | 0.7 | 1 | | 0.7 |
| 60s loop | | | | | | | |
| N62A | 0.5 | 1.1 | 1.7 | 2.2 | | | 2.0 |
| D63A | 5.2±0.6 | 13.4±1.4 | 1.7 | 0.9 | 8 | 7 | 0.5 |
| E64A | 2.4 | 3.2±0.1 | 1.7 | 1.7 | 5 | 5 | 8.5 |
| G65A | 0.6 | 1.5 | 1.6 | 1.7 | 1 | 1 | 1.3 |
| L66A | 0.7 | 2 | 1.8 | 1.6 | 10 | 47 | 0.3 |
| 80s loop | | | | | | | |
| M81A | 1.3 | 4.2±1.2 | 1.8 | NB | 5 | 7 | 2.0 |
| R82A | 1.3 | 1.1 | 1.3 | 3.3 | | | 0.6 |
| I83A | 39.9±11.1 | 17.6±0.9 | 0.9 | 1.0 | 7 | 5 | 100.0 |
| K84A | 0.8 | 1.8 | 1.5 | 1.8 | | | 2.2 |
| H86A | 7.5±1.1 | 2.8 | 0.8 | 1.9 | 1 | 1 | 1.3 |
| Q87A | 2.3 | 3.2±0.1 | 1.1 | 1.3 | | | 1.8 |
| G88A | 2.7 | 1.6 | 1.1 | NB | | | 1.0 |
| Q89A | 91.5±19.2 | 8945±5815 | >100 | NB | 1 | 1 | 2.5 |
| H90A | 1 | 1 | 1.2 | 1.8 | | | 1.7 |
| I91A | 6.9±0.4 | 2.8 | 1.3 | 1.2 | 1 | 1 | 1.0 |
| G92A | 0.9 | 1.6 | 1.4 | 8.5 | | | 1.2 |
| E93A | 2.9 | 1.4 | 1.2 | 6.6 | | | 0.5 |
| M94A | 1 | 0.8 | 1.1 | NB | | | 2.8 |
| | | | | | | | |
| E103A | 0.7 | 0.8 | 1 | 2.3 | | | 1.1 |
| P106 | 1.8 | 1.2 | | | | 6 | |
| R105A | 1.6 | 0.7 | 0.9 | 1.4 | | 1 | 0.8 |
| | | | | | | | |
| | | (black) | | >20 | | | |
| | | (grey) | | 5~20 | | | |

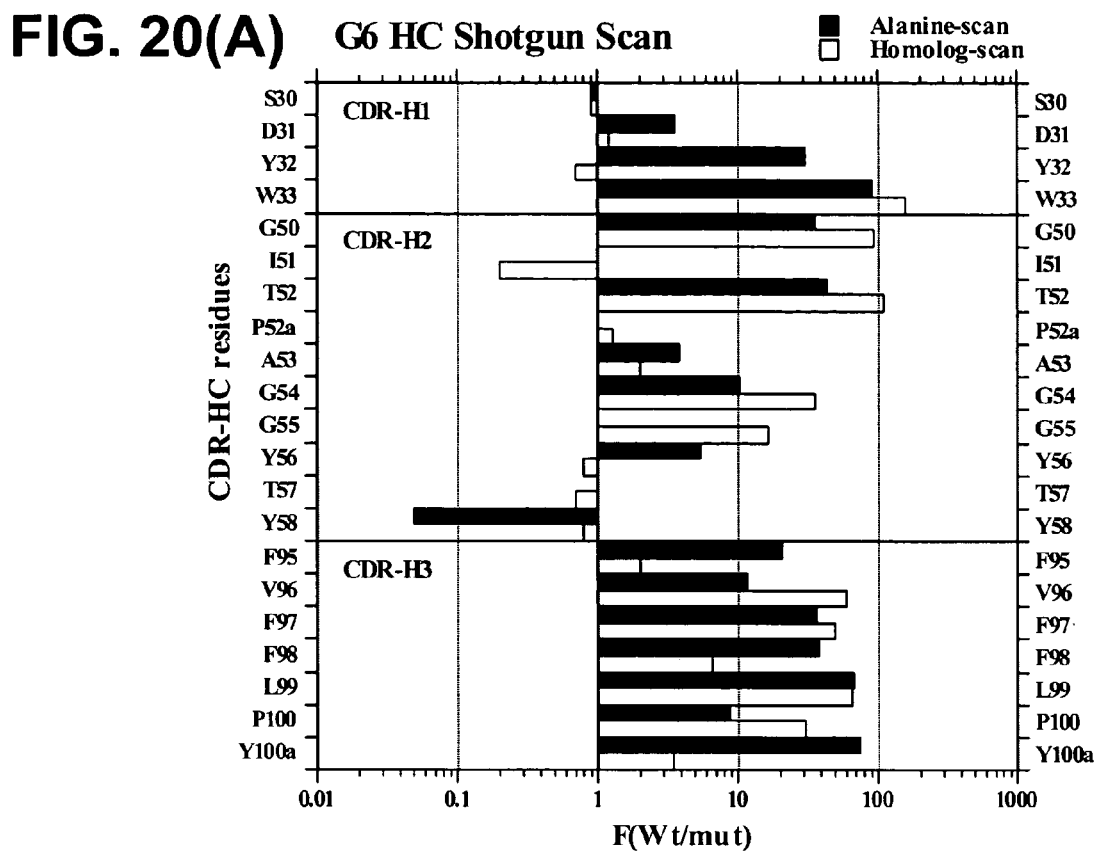
FIG. 20(A) G6 HC Shotgun Scan
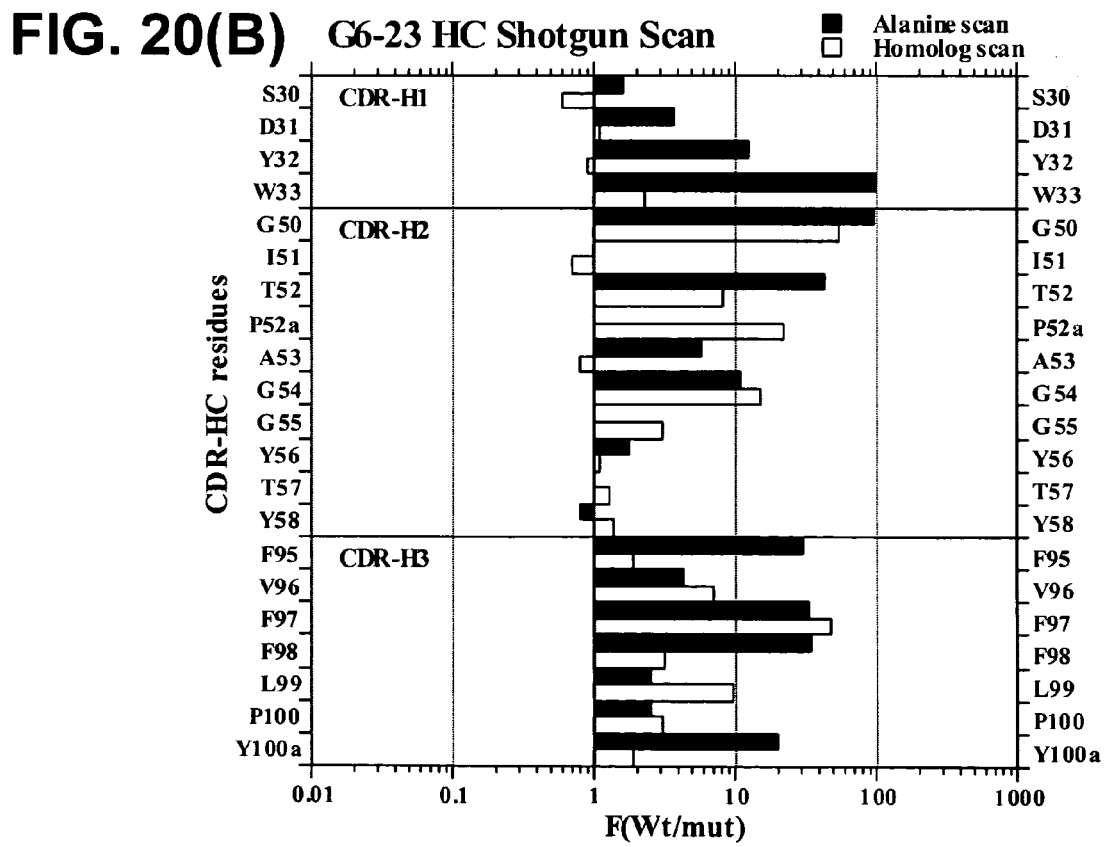
FIG. 20(B) G6-23 HC Shotgun Scan

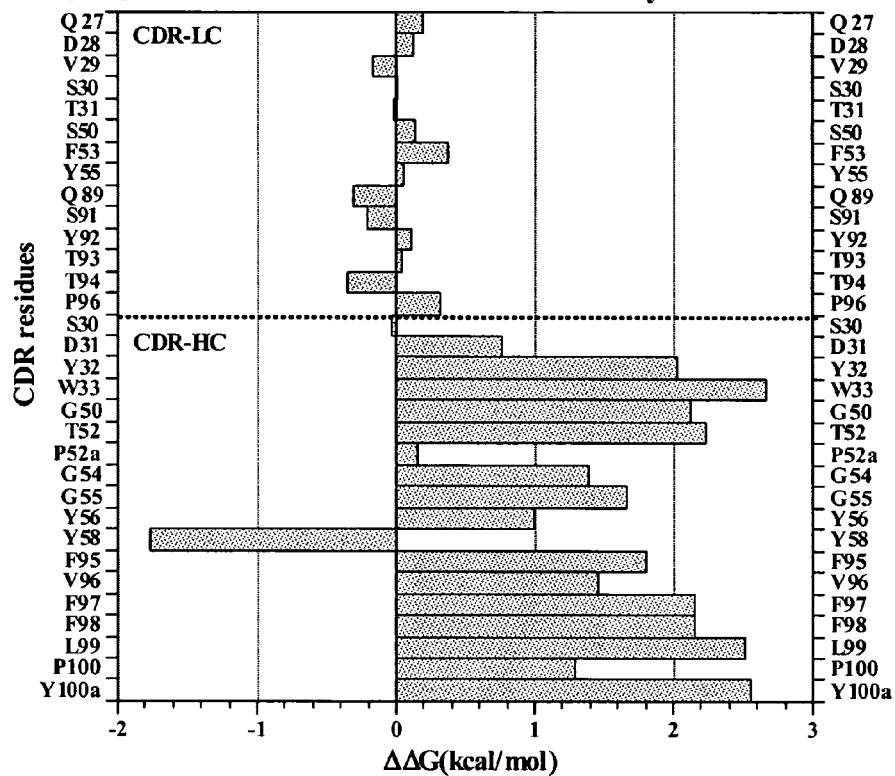
FIG. 22(A) Energetic contributions of CDR residues on G6 anti-VEGF antibody
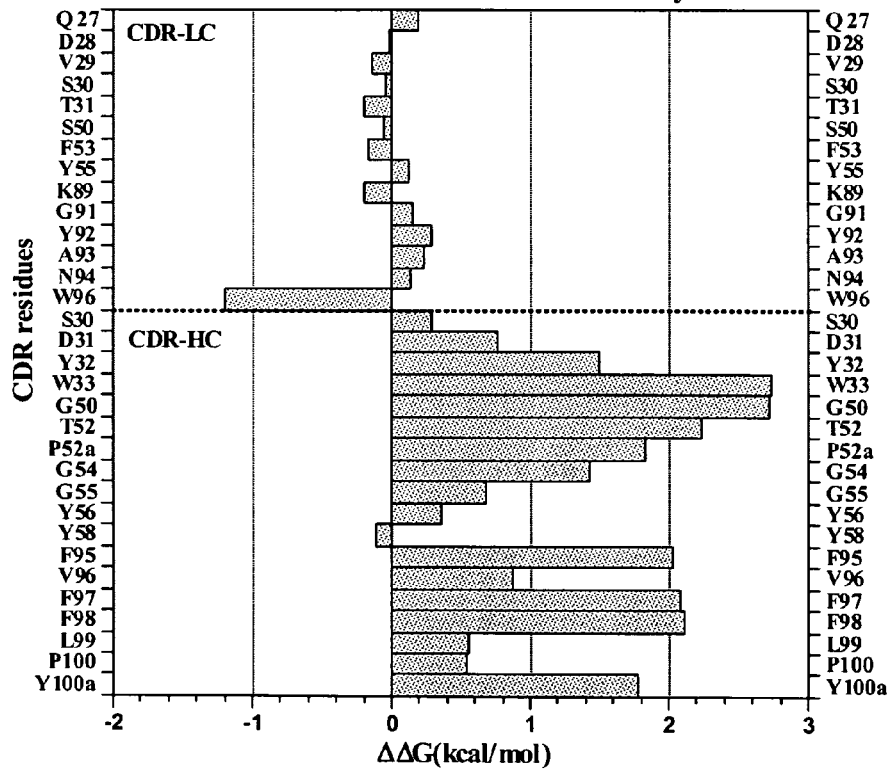
FIG. 22(B) Energetic contributions of CDR residues on G6-23 anti-VEGF antibody

FIG. 24

G6 Fab Light chain

DIQMTQSPSSLSASVGDRVTITCRASQDVSTAVAWYQQKPGKAPKLLIYSASFLYSGVP
SRFSGSGSGTDFTLTISSLQPEDFATYYCQQSYTTPPTFGQGTKVEIKRTVAAPSVFIF
PPSDEQLKSGTASVVCLLNNFYPREAKVQWKVDNALQSGNSQESVTEQDSKDSTYSLSS
TLTLSKADYEKHKVYACEVTHQGLSSPVTKSFNRGEC

G6 Fab Heavy chain

EVQLVESGGGLVQPGGSLRLSCAASGFTISDYWIHWVRQAPGKGLEWVAGITPAGGYTY
                                                        a
YADSVKGRFTISADTSKNTAYLQMNSLRAEDTAVYYCARFVFFLPYAMDYWGQGTLVTV
SSASTKGPSVFPLAPSSKSTSGGTAALGCLVKDYFPEPVTVSWNSGALTSGVHTFPAVL
QSSGLYSLSSVVTVPSSSLGTQTYICNVNHKPSNTKVDKKVEPKSCDKTH

FIG. 25

G6-23 light chain

DIQMTQSPSSLSASVGDRVTITCRASQDVSTAVAWYQQKPGKAPKLLIYSASFLYS
GVPSRFSGSGSGTDFTLTISSLQPEDFATYYCKQGYANPWTFGQGTKVEIKRTVAA
PSVFIFPPSDEQLKSGTASVVCLLNNFYPREAKVQWKVDNALQSGNSQESVTEQDS
KDSTYSLSSTLTLSKADYEKHKVYACEVTHQGLSSPVTKSFNRGEC

G6-23 Fab Heavy chain

EVQLVESGGGLVQPGGSLRLSCAASGFTISDYWIHWVRQAPGKGLEWVAGITPAGG
YTYYADSVKGRFTISADTSKNTAYLQMNSLRAEDTAVYYCARFVFFLPYAMDYWGQ
GTLVTVSSASTKGPSVFPLAPSSKSTSGGTAALGCLVKDYFPEPVTVSWNSGALTS
GVHTFPAVLQSSGLYSLSSVVTVPSSSLGTQTYICNVNHKPSNTKVDKKVEPKSCD
KTH

G6-31 light chain (heavy chain sequence same as G6)
DIQMTQSPSSLSASVGDRVTITCRASQDVSTAVAWYQQKPGKAPKLLIYSASFLYS
GVPSRFSGSGSGTDFTLTISSLQPEDFATYYCQQGYGNPFTFGQGTKVEIKRTVAA
PSVFIFPPSDEQLKSGTASVVCLLNNFYPREAKVQWKVDNALQSGNSQESVTEQDS
KDSTYSLSSTLTLSKADYEKHKVYACEVTHQGLSSPVTKSFNRGEC G6-8 light chain (heavy chain sequence same as G6)
DIQMTQSPSSLSASVGDRVTITCRASQDVSTAVAWYQQKPGKAPKLLIYSASFLYS
GVPSRFSGSGSGTDFTLTISSLQPEDFATYYCQQGAGSPLITFGQGTKVEIKRTVAA
PSVFIFPPSDEQLKSGTASVVCLLNNFYPREAKVQWKVDNALQSGNSQESVTEQDS
KDSTYSLSSTLTLSKADYEKHKVYACEVTHQGLSSPVTKSFNRGEC

FIG. 26

G6-23.1 light chain

DIQMTQSPSSLSASVGDRVTITCRASQDVSTAVAWYQQKPGKAPKLLIYSASFLYSGVPSRFSGSGSGT
DFTLTISSLQPEDFATYYCKQGFANPFTFGQGTKVEIKRTVAAPSVFIFPPSDEQLKSGTASVVCLLNN
FYPREAKVQWKVDNALQSGNSQESVTEQDSKDSTYSLSSTLTLSKADYEKHKVYACEVTHQGLSSPVTK
SFNRGEC

G6-23.1 Fab Heavy chain

EVQLVESGGGLVQPGGSLRLSCAASGFTISDYWIHWVRQAPGKGLEWVAGVTPAGGYTYYADSVKGRF
TISADTSKNTAYLQMNSLRAEDTAVYYCARFVFFLPYAMDYWGQGTLVTVSSASTKGPSVFPLAPSSK
STSGGTAALGCLVKDYFPEPVTVSWNSGALTSGVHTFPAVLQSSGLYSLSSVVTVPSSSLGTQTYICN
VNHKPSNTKVDKKVEPKSCDKTH

G6-23.2 light chain (same as G6-23.1)

DIQMTQSPSSLSASVGDRVTITCRASQDVSTAVAWYQQKPGKAPKLLIYSASFLYSGVPSRFSGSGSGT
DFTLTISSLQPEDFATYYCKQGFANPFTFGQGTKVEIKRTVAAPSVFIFPPSDEQLKSGTASVVCLLNN
FYPREAKVQWKVDNALQSGNSQESVTEQDSKDSTYSLSSTLTLSKADYEKHKVYACEVTHQGLSSPVTK
SFNRGEC

G6-23.2 Fab Heavy chain

EVQLVESGGGLVQPGGSLRLSCAASGFTISDYWIHWVRQAPGKGLEWVAGVTPAGGYTAYADSVKGRF
TISADTSKNTAYLQMNSLRAEDTAVYYCARFVFFLPYAMDYWGQGTLVTVSSASTKGPSVFPLAPSSK
STSGGTAALGCLVKDYFPEPVTVSWNSGALTSGVHTFPAVLQSSGLYSLSSVVTVPSSSLGTQTYICN
VNHKPSNTKVDKKVEPKSCDKTH

FIG. 27

B20 (Fab) Light chain
DIQMTQSPSSLSASVGDRVTITCRASQDVSTAVAWYQQKPGKAPKLLIYSASFLYS
GVPSRFSGSGSGTDFTLTISSLQPEDFATYYCQQSYTTPPTFGQGTKVEIKRTVAA
PSVFIFPPSDEQLKSGTASVVCLLNNFYPREAKVQWKVDNALQSGNSQESVTEQDS
KDSTYSLSSTLTLSKADYEKHKVYACEVTHQGLSSPVTKSFNRGEC B20 (Fab) Heavy chain
EVQLVESGGGLVQPGGSLRLSCAASGFTINASWIHWVRQAPGKGLEWVGAIYPYSG
YTNYADSVKGRFTISADTSKNTAYLQMNSLRAEDTAVYYCARWGHSTSPWAMDYWG
QGTLVTVSSASTKGPSVFPLAPSSKSTSGGTAALGCLVKDYFPEPVTVSWNSGALT
SGVHTFPAVLQSSGLYSLSSVVTVPSSSLGTQTYICNVNHKPSNTKVDKKVEPKSC
DKTH

FIG. 28

| Clone No. | CDR-L1 | | | | | | CDR-L2 | | | CDR-L3 | | | | | IC50 (nM) | |
|---|---|---|---|---|---|---|---|---|---|---|---|---|---|---|---|---|
| | 28 | 29 | 30 | 31 | 32 | 33 | 50 | 53 | 55 | 91 | 92 | 93 | 94 | 96 | mVEGF | hVEGF |
| B20 | D | V | S | T | A | V | S | F | Y | S | Y | T | T | P | 22 | 159 |
| B20-50 | D | V | S | T | A | V | S | F | Y | S | Y | G | A | L | 8.8 | 44.7 |
| B20-59 | D | V | S | T | A | V | S | F | Y | S | Y | S | S | L | 9.3 | 34.4 |
| B20-73 | G | V | R | T | S | L | G | T | A | S | Y | A | S | L | 13.8 | 8.6 |
| B20-3 | V | I | G | R | S | L | S | F | Y | S | Y | G | S | L | 6.2 | 6.3 |
| B20-8 | D | V | S | T | A | V | S | F | Y | S | Y | A | A | L | 2.6 | 21.5 |
| B20-2 | N | V | R | S | S | L | S | N | E | S | Y | G | S | L | 6.2 | 9.6 |
| B20-4a | V | I | G | T | S | L | S | N | A | S | Y | T | S | L | 7.7 | 24.8 |
| B20-4 | V | I | R | R | A | V | A | T | A | S | N | T | N | L | 8.2 | 6 |
| B20-6 | D | V | S | T | S | L | S | F | A | S | T | T | A | L | 6.8 | 43 |
| B20-5 | D | V | S | T | A | V | G | T | Y | S | T | N | S | L | 8 | 57 |
| B20-1a | G | V | K | N | S | L | S | T | E | S | N | A | S | L | 7.3 | 11.6 |
| B20-1 | D | V | R | T | F | L | G | T | A | S | T | S | N | L | 4.6 | 6 |
| B20-13 | N | V | R | N | L | L | S | A | A | H | T | N | S | L | 2.8 | 28.5 |

FIG. 29

B20-4 (+light chain randomization) Fab

Light chain
DIQMTQSPSSLSASVGDRVTITCRASQVIRRSLAWYQQKPGKAPKLLIYAASNLASGVPSRFSGSGSGTDFTLTI
SSLQPEDFATYYCQQSNTSPLTFGQGTKVEIKRTVAAPSVFIFPPSDEQLKSGTASVVCLLNNFYPREAKVQWKV
DNALQSGNSQESVTEQDSKDSTYSLSSTLTLSKADYEKHKVYACEVTHQGLSSPVTKSFNRGEC Heavy chain (same as B20)
EVQLVESGGGLVQPGGSLRLSCAASGFTINASWIHWVRQAPGKGLEWVGAIYPYSGYTNYADSVKGRFTISADTS
KNTAYLQMNSLRAEDTAVYYCARWGHSTSPWAMDYWGQGTLVTVSSASTKGPSVFPLAPSSKSTSGGTAALGCLV
KDYFPEPVTVSWNSGALTSGVHTFPAVLQSSGLYSLSSVVTVPSSSLGTQTYICNVNHKPSNTKVDKKVEPKSCD
KTH

B20-4.1

Light chain
DIQMTQSPSSLSASVGDRVTITCRASQVIRRSLAWYQQKPGKAPKLLIYAASNLASGVPSRFSGSGSGTDFTLTI
SSLQPEDFATYYCQQSNTSPLTFGQGTKVEIKRTVAAPSVFIFPPSDEQLKSGTASVVCLLNNFYPREAKVQWKV
DNALQSGNSQESVTEQDSKDSTYSLSSTLTLSKADYEKHKVYACEVTHQGLSSPVTKSFNRGEC Heavy chain
EVQLVESGGGLVQPGGSLRLSCAASGFSINGSWIFWVRQAPGKGLEWVGAIWPFGGYTHYADSVKGRFTISADTS
KNTAYLQMNSLRAEDTAVYYCARWGHSTSPWAMDYWGQGTLVTVSSASTKGPSVFPLAPSSKSTSGGTAALGCLV
KDYFPEPVTVSWNSGALTSGVHTFPAVLQSSGLYSLSSVVTVPSSSLGTQTYICNVNHKPSNTKVDKKVEPKSCD
KTH

FIG. 32

| | $k_{on}(\times 10^4) M^{-1}s^{-1}$ | | $k_{off}(\times 10^{-4})s^{-1}$ | | $K_d(k_{off}/k_{on})$ nM | | $IC_{50}$ nM | |
|---|---|---|---|---|---|---|---|---|
| | hVEGF | mVEGF | hVEGF | mVEGF | hVEGF | mVEGF | hVEGF | mVEGF |
| 25 C | | | | | | | | |
| G6 | 15.2 | 19.3 | 2.5 | 1.3 | 1.6 | 0.7 | 2.1 | 0.6 |
| G6-8 | ~50 | ~50 | 2.6 | 1.2 | ~0.5 | ~0.3 | 0.07 | 0.06 |
| G6-31 | ~50 | ~50 | 0.9 | 0.3 | ~0.2 | ~0.08 | 0.02 | 0.03 |
| G6-23 | ~126 | ~114 | 2.6 | 1.2 | ~0.2 | ~0.1 | 0.01 | 0.01 |
| Avastin | 4.1 | NB | 1.2 | NB | 2.9 | NB | 1.1 | NB |
| Y0317 | 3.6 | ND | ≤0.05 | ND | ~0.2 | ND | 0.02 | ~300 |
| 37 C | | | | | | | | |
| G6 | 24.4 | 25.5 | 21.1 | 8 | 8.6 | 3.1 | 3.5 | ND |
| G6-8 | ~80 | ~100 | 25.3 | 12.4 | ~3.2 | ~1.2 | 0.13 | ND |
| G6-31 | ~80 | ~100 | 3.4 | 0.6 | ~0.4 | ~0.06 | 0.04 | ND |
| G6-23 | ~120 | ~138 | 7.8 | 2.8 | ~0.6 | ~0.2 | 0.04 | ND |
| Avastin | 5.1 | NB | 6.6 | NB | 12.9 | NB | 2.5 | NB |
| Y0317 | 5.4 | ND | 0.06 | ND | 0.11 | ND | ND | ND |

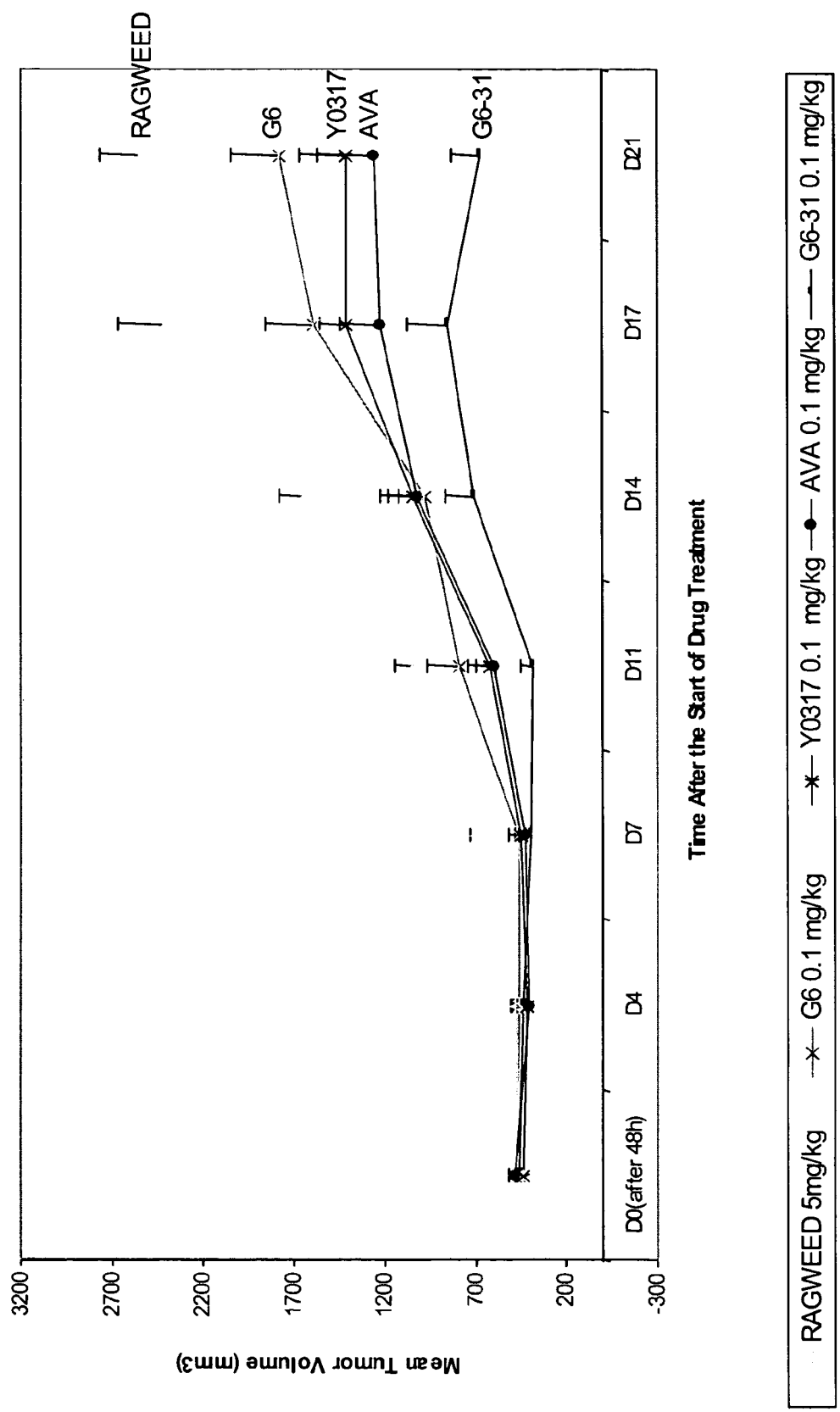

| # | CDR-H1 | CDR-H2 | CDR-H3 |
|---|--------|--------|--------|
| 1 | G F D S Y Y D I H W | W V A S H A P Y A G A T Y Y A D | C S R A A D Y A Y D A M D Y |
| 2 | G F N T Y Y S I H W | W V A T H S P T Y G S T Y Y A D | C S R S S N N Y S Y Y A M D Y |
| 3 | G F S S D Y D I H W | W V A T H A P Y S G Y T Y Y A D | C S R S S Y A Y Y S A M D Y |
| 4 | G F N Y Y Y S I H W | W V A S H A P Y Y G T T Y Y A D | C S R S T N T N Y Y A M D Y |
| 5 | G F S I Y D Y A I H W | W V A S H Y P A Y G A T Y Y A D | C S R G A A Y A Y Y A A M D Y |
| 6 | G F S D Y Y D I H W | W V A S H A P Y A G S T Y Y A D | C S R S A A Y Y Y D A M D Y |
| 7 | G F A A Y Y A I H W | W V A S H A P Y A G Y T D Y A D | C S R S S Y A Y Y D A M D Y |
| 8 | G F D I S A S D I H W | W V A S H Y P A A G A T Y Y A D | C S R D A A Y Y Y A S A M D Y |
| 9 | G F D I Y D Y D I H W | W V A S H A P Y A G S T Y Y A D | C S R S A A Y Y A A S A M D Y |
| 10 | G F A A Y Y D I H W | W V A S H A P Y A G A T Y Y A D | C S R A A A A Y Y A Y A M D Y |
| 11 | G F D I Y D Y Y D I H W | W V A S H A P Y A G A T Y Y A D | C S R A A Y A Y Y A A M D Y |
| 12 | G F D D Y Y A I H W | W V A S H A P Y A G A T Y Y A D | C S R S A A Y Y Y A A A M D Y |
| 13 | G F A A A A A I H W | W V A S H A P Y A G A T Y Y A D | C S R A A A A Y Y Y D A M D Y |
| 14 | G F A A A A A I H W | W V A S H Y P S A G A T Y Y A D | C S R A A Y A Y Y A A M D Y |
| 15 | G F Y A D A A I H W | W V A S H Y P S A G A T Y Y A D | C S R A Y D S D Y Y A M D Y |

FIG. 38

| | CDR-H1 | | | | | CDR-H2 | | | | | | CDR-H3 | | | | | | |
|---|---|---|---|---|---|---|---|---|---|---|---|---|---|---|---|---|---|---|
| 16F | A | I | Y | D | Y | D | H | W | V | A | D | I | Y | P | Y | A | G | A | T | A | Y | R | S | Y | A | Y | Y | A | A | M | D |
| 17F | D | D | Y | D | Y | S | I | H | W | V | A | Y | I | S | P | Y | A | G | A | T | A | Y | R | S | S | Y | A | Y | Y | D | A | M | D |
| 18F | A | A | A | Y | A | A | I | H | W | V | A | D | I | Y | P | A | S | G | D | T | S | Y | R | S | Y | Y | S | Y | S | Y | A | M | D |
| 19 | | | | | | | | | | A | S | I | A | P | S | Y | G | A | T | A | Y | R | A | Y | D | Y | Y | A | A | Y | A | M | D |
| 20F | D | S | A | Y | A | A | I | H | W | V | A | Y | I | S | P | Y | Y | G | A | T | A | Y | R | S | A | Y | Y | S | Y | S | A | M | D |
| 21 | | | | | | | | | | A | S | I | A | P | S | Y | G | A | T | D | Y | R | A | Y | Y | Y | Y | Y | A | A | M | D |
| 22 | | | | | | | | | | | | | | | | | | | | | | R | S | S | D | A | S | Y | S | Y | A | M | D |
| 23F | D | I | Y | D | D | D | I | H | W | V | A | S | I | Y | P | S | S | G | D | T | Y | Y | R | D | V | S | Y | S | S | Y | A | M | D |
| 24 | | | | | | | | | | | | | | | | | | | | | | | | | | | | | | | | | |

FIG. 39

YADS2 Light Chain
DIQMTQSPSSLSASVGDRVTITCRASQSYAYAVAWYQQKPGKAPKLLIYDASYLYSGVP
SRFSGSGSGTDFTLTISSLQPEDFATYYCQQAYSSPDTFGQGTKVEIKRTVAAPSVFIFPPS
DEQLKSGTASVVCLLNNFYPREAKVQWKVDNALQSGNSQESVTEQDSKDSTYSLSSTLT
LSKADYEKHKVYACEVTHQGLSSPVTKSFNRGEC YADS2 Heavy Chain
MKKNIAFLLASMFVFSIATNAYAEVQLVESGGGLVQPGGSLRLSCAASGFAISDYDIHWV
RQAPGKGLEWVADIAPYAGATAYADSVKGRFTISADTSKNTAYLQMNSLRAEDTAVYY
CSRSSYAYYAAMDYWGQGTLVTVSSASTKGPSVFPLAPSSKSTSGGTAALGCLVKDYFP
EPVTVSWNSGALTSGVHTFPAVLQSSGLYSLSSVVTVPSSSLGTQTYICNVNHKPSNTKV
DKKVEPKSCDKTH YADS3 Light Chain
DIQMTQSPSSLSASVGDRVTITCRASQASYYDVAWYQQKPGKAPKLLIYAASYLYSGVP
SRFSGSGSGTDFTLTISSLQPEDFATYYCQQYYYAPATFGQGTKVEIKRTVAAPSVFIFPPS
DEQLKSGTASVVCLLNNFYPREAKVQWKVDNALQSGNSQESVTEQDSKDSTYSLSSTLT
LSKADYEKHKVYACEVTHQGLSSPVTKSFNRGEC YADS3 Heavy Chain
MKKNIAFLLASMFVFSIATNAYAEVQLVESGGGLVQPGGSLRLSCAASGFSISDYDIHWV
RQAPGKGLEWVAAIAPYSGSTYYADSVKGRFTISADTSKNTAYLQMNSLRAEDTAVYY
CSRSSYAYYSAMDYWGQGTLVTVSSASTKGPSVFPLAPSSKSTSGGTAALGCLVKDYFP
EPVTVSWNSGALTSGVHTFPAVLQSSGLYSLSSVVTVPSSSLGTQTYICNVNHKPSNTKV
DKKVEPKSCDKTH

FIG. 40

| clone | H1 (27) | | | | | (36) | H2 (49) | (50) | | | | | | (59) | H3 | (95) | | (97) | | (99) | (100) | (100a) | (102) |
|---|---|---|---|---|---|---|---|---|---|---|---|---|---|---|---|---|---|---|---|---|---|---|---|
| NNK-1 | F | A | I | Y | D | D | A | S | – | A | P | Y | A | G | A | T | A | Y | R | E | S | L | S | F | A | H | W | S | A | M |
| NNK-2 | F | A | I | Y | D | D | A | L | – | A | P | Y | A | G | A | T | A | Y | R | R | S | F | S | F | A | F | W | L | A | M |
| NNK-3 | F | A | I | Y | D | D | A | M | – | A | P | Y | A | G | A | T | A | Y | R | R | S | F | S | F | A | F | W | N | A | M |
| NNK-4 | F | A | I | Y | D | D | A | R | – | A | P | Y | A | G | A | T | A | Y | R | R | S | F | S | F | A | F | F | S | A | M |
| NNK-5 | F | A | I | Y | D | D | A | S | – | A | P | Y | A | G | A | T | A | Y | R | A | S | F | S | L | A | F | F | S | A | M |
| NNK-6 | F | A | I | Y | D | D | A | M | – | A | P | Y | A | G | A | T | A | Y | R | x | S | L | S | F | A | L | Y | D | A | M |
| NNK-7 | F | A | I | Y | D | D | A | Y | – | A | P | Y | A | G | A | T | A | Y | R | F | S | F | S | F | A | F | R | M | A | M |
| NNK-8 | F | A | I | Y | D | D | A | G | – | A | P | Y | A | D | A | T | A | Y | R | G | S | F | S | F | A | F | F | G | A | M |
| NNK-9 | F | A | I | Y | D | D | A | L | – | A | P | Y | A | G | A | T | A | Y | R | S | S | Y | S | F | A | R | W | S | A | M |
| NNK-10 | F | A | I | Y | D | D | A | Y | – | A | P | Y | A | G | A | T | A | Y | A | S | S | Y | S | F | Y | A | R | R | A | M |
| NNK-11 | F | A | I | Y | D | D | H | I | – | A | P | Y | A | G | A | T | A | Y | R | N | S | F | S | F | A | F | F | G | A | M |
| NNK-12 | F | A | I | Y | D | D | A | V | – | A | P | Y | A | G | A | T | A | Y | R | S | S | F | S | F | A | W | W | M | A | M |
| NNK-13 | F | A | I | Y | D | D | A | F | – | A | P | Y | A | G | A | T | A | Y | R | G | S | F | S | F | A | F | F | S | A | M |
| NNK-14 | F | A | I | Y | D | D | A | F | – | A | P | Y | A | G | A | T | A | Y | R | N | S | F | S | F | A | F | W | G | A | M |
| NNK-15 | F | A | I | Y | D | D | A | V | – | A | P | Y | A | G | A | T | A | Y | R | S | S | F | S | F | A | F | F | M | A | M |
| NNK-16 | F | A | I | Y | D | D | A | N | – | A | P | Y | A | G | A | T | A | Y | R | R | S | F | S | F | A | F | F | G | A | M |
| NNK-17 | F | A | I | Y | D | D | A | V | – | A | P | Y | A | G | A | T | A | Y | R | S | S | F | S | F | A | F | Y | N | A | M |
| NNK-18 | F | A | I | Y | D | D | A | F | – | A | P | Y | A | G | A | T | A | Y | R | L | S | F | S | F | A | Y | K | A | A | M |
| NNK-19 | F | A | I | Y | D | D | A | F | – | A | P | Y | A | G | A | T | A | Y | R | V | S | L | S | W | A | L | Y | N | A | M |
| NNK-20 | F | A | I | Y | D | D | A | A | – | A | P | Y | A | G | A | T | A | Y | R | L | S | F | S | L | A | Y | F | Q | A | M |
| NNK-21 | F | A | I | Y | D | D | A | Y | – | A | P | Y | A | G | A | T | A | Y | R | V | S | F | S | F | A | F | F | H | A | M |
| NNK-22 | F | A | I | Y | D | D | A | W | – | A | P | Y | A | G | A | T | A | Y | R | L | S | F | S | F | A | H | M | G | A | M |
| NNK-23 | F | A | I | Y | D | D | A | V | – | A | P | Y | A | G | A | T | A | Y | R | N | S | F | S | F | A | F | F | G | A | M |
| NNK-24 | F | A | I | Y | D | D | A | V | – | A | P | Y | A | G | A | T | A | Y | R | I | S | F | S | F | A | F | F | G | A | M |
| NNK-25 | F | A | I | Y | D | D | A | S | – | A | P | Y | A | G | A | T | A | Y | R | S | S | F | S | F | A | F | F | H | A | M |
| NNK-26 | F | A | I | Y | D | D | A | V | – | A | P | Y | A | G | A | T | A | Y | R | N | S | F | S | F | A | F | F | G | A | M |
| NNK-27 | F | A | I | Y | D | D | A | V | – | A | P | Y | A | G | A | T | A | Y | R | N | S | F | S | F | A | F | F | G | D | M |

|    | CDR-L3 | CDR-H1 | CDR-H2 | CDR-H3 |
|----|--------|--------|--------|--------|
| 1  | S S Y S Y | S S S S S | Y S S S S S | Y Y S S S Y Y Y S Y Y Y |
| 2  | S S Y S Y | S Y Y S S | Y S S S S S | Y Y S S S S Y Y S Y Y Y |
| 3  | S Y Y S Y | S S Y S S | Y S Y S S S | Y S S Y S S S S Y Y S S Y Y Y |
| 4  | S Y Y S Y | S S S S S | Y S Y S S S | Y Y Y S Y Y S S S Y S S Y Y Y |
| 5  | S S Y Y S | S S S S S | Y S Y S S S | Y S S Y S S S Y S S Y S Y Y Y |
| 6  | S Y Y S Y | S S Y S S | Y S S S S S | Y S S Y S S Y S S S Y S Y Y Y |
| 7  | S S Y S Y | S S S S S | Y S Y S Y S | Y S Y S Y S S S S S S Y Y Y |
| 8  | S Y Y S Y | S S S S S | Y S S S Y S | Y Y S S Y S S Y S S Y S Y Y Y |
| 9  | S Y Y S Y | S S Y S S | Y S Y S S S | Y Y S S Y S Y Y S S S Y Y Y |
| 10 | S Y S S Y | S S S S S | Y S S S S S | Y S S Y S Y S S S Y S Y Y Y |
| 11 | S Y Y S Y | S S S S S | Y S S S Y S | Y S S S S Y S S Y S S Y Y Y |
| 12 | S Y S S Y | Y S S S S | Y S S S S S | Y S S S S S Y Y S S S Y Y Y |
| 13 | S Y Y S Y | S S S S S | Y S S S S S | Y S Y S S S Y Y Y S Y Y Y |
| 14 | S Y Y S Y | S S S S S | Y S Y S S S | Y S S S S Y S S Y Y S Y Y Y |
| 15 | S Y S Y S | S S S S S | Y S Y S S Y | Y S S Y S Y S S S Y S Y Y Y |
| 16 | S Y S S Y | S S S S S | Y S Y S S Y | Y S Y Y S Y S S Y S S Y Y Y |
| 17 | S Y Y Y S | S S S S S | S S Y Y Y S | Y S S Y S S Y S S Y S Y Y Y |
| 18 | S Y S S Y | S Y S S S | Y S Y S S S | Y S Y S S S S S Y S S Y Y Y |
| 19 | S Y S S Y | S S S S S | Y S Y S Y S | Y S S S Y Y S S Y S S Y Y Y |
| 20 | S Y S S Y | S S S S S | Y S Y S S S | Y S Y S S S S S Y S S Y Y Y |
| 21 | S Y S S Y | S Y Y S S | Y S S S S S | Y S Y Y S Y S S Y Y S Y Y Y |
| 22 | S S S S Y | S Y S S S | Y S Y S Y S | Y Y S S Y S S Y S S S Y Y Y |
| 23 | S Y S S Y | S S S S S | Y S Y S Y S | Y Y Y S Y Y S S S Y S Y Y Y |
| 24 | S Y Y S Y | S S S S S | Y S S S S S | Y Y S Y S S Y S S S S Y Y Y |
| 25 | S Y S S Y | S Y Y S S | Y S S S S S | Y Y S S S Y S S Y S S Y Y Y |
| 26 | S S S S Y | S S S S S | Y S Y S S S | Y S Y S S S S S Y S Y Y Y |
| 27 | S Y Y S Y | S Y Y S S | S S Y S Y S | Y S S S S Y S Y S S Y Y Y |
| 28 | S S S S Y | S S S S S | Y S S Y S S | Y Y S S S Y S Y Y S Y Y Y |
| 29 | S Y Y S Y | S S S S S | Y S Y S Y S | Y S S S S S S Y Y S Y Y Y |
| 30 | S S S S Y | S S S S S | Y S S S S S | Y S S S Y Y S S Y S Y Y Y |
| 31 | S Y Y S Y | S Y S S S | Y S S S S S | Y S S S S Y S Y S S Y Y Y |
| 32 | S S S S Y | S Y S S S | Y S S S S S | Y Y S S S S S Y Y S Y Y Y |
| 33 | S S Y S Y | Y S S S S | Y S S S Y S | Y S S Y S S S Y S S Y Y Y |
| 34 | S Y S S Y | S S S S S | Y S Y S S S | Y S S S S Y S S S S Y Y Y |
| 35 | S Y Y S Y | S S S S S | Y S S S S S | Y S S S S Y S Y S S Y Y Y |
| 36 | S Y S S Y | S Y S S S | Y S Y S S Y | Y S S S S S S Y S S Y Y Y |
| 37 | S Y Y S Y | S S S S S | Y S Y S S Y | Y Y S S S S Y S S Y Y Y |
| 38 | S Y Y S Y | S Y S S S | Y S S S S S | Y S Y S S Y S S Y S S Y Y |
| 39 | S Y Y S Y | S Y S S S | Y S Y S S S | Y Y S S S Y S Y S Y Y Y |
| 40 | S S Y S Y | S Y S S S | Y S S S S S | Y Y Y S Y S S Y S Y Y Y |
| 41 | S Y Y S Y | S S S S S | Y S S S S S | Y S Y S Y S S Y S Y Y Y |
| 42 | S S S S Y | S S Y S S | Y S Y S S S | Y S S S S S Y S S Y Y Y |
| 43 | S Y S S Y | S S S S S | Y S Y S S S | Y S S S S Y Y Y S Y Y Y |
| 44 | S Y S S Y | S Y S S S | Y S S S S S | Y S S S S Y Y S Y Y Y |
| 45 | S Y S S Y | S S S S S | S S Y S Y S | Y S S Y S Y Y S Y Y Y |
| 46 | S Y Y S Y | S Y S S S | Y S S S Y S | Y S S S S Y S Y S Y Y Y |
| 47 | S S S S Y | S S S S S | Y S Y S S S | Y S S S Y S S Y S Y Y Y |
| 48 | S Y Y Y S | S S S S S | Y S Y S Y S | Y S Y S S S S S S Y Y Y |
| 49 | S S Y S Y | S Y S S S | Y S Y S S S | Y S S S Y Y Y Y S Y S Y |
| 50 | S Y Y S Y | S S S S S | Y S S S S S | Y S S S Y Y Y S Y Y Y |
| 51 | S Y Y S Y | S S S S S | Y S Y S S S | Y S S S Y S Y S Y Y Y |
| 52 | S Y Y Y S | S S S S Y | S Y Y Y S | S S S S S Y Y S |
| 53 |        | Y S S S S | S S Y S Y Y | S Y Y S S S Y S S S Y Y S S |
| 54 |        | S S S S S | S S S S S Y | S Y Y S S S Y S S S Y Y S S |
| 55 |        | S S S S S | S S S S S Y | S Y Y S S S Y Y S Y Y S S |
| 56 |        | S S S S S | S S Y S Y Y | S Y Y S S S Y Y S Y Y S S |
| 57 |        | Y S S S S | S S Y S S Y | S Y Y S S S Y Y S Y Y S S |
| 58 |        | S S S S S | S S Y S S Y | S Y Y S S S Y Y Y Y Y S S |
| 59 |        | S S S S S | S S S Y Y S | S Y Y S S S Y S S Y Y S S |
| 60 |        | S S S S S | S S Y S S Y | S Y Y S S S Y S S Y Y S S |
| 61 |        | S S S Y S | S S Y S S Y | S Y Y Y S S Y S S Y Y S S |
| 62 |        | S S Y S S | S S S S Y Y | S Y Y S S S Y S S Y Y S S |
| 63 |        | S S S S S | S S Y S Y Y | S S Y S S S Y Y S Y Y S S |

FIG. 43

YS1 Fab Sequence

Light Chain

DIQMTQSPSSLSASVGDRVTITCRASQSYAYAVAWYQQKPGKAPKLLIYDASYLYSGVPSRFSGSGSGTDFTLT
ISSLQPEDFATYYCQQSSYSPYTFGQGTKVEIKRTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

Heavy Chain

EVQLVESGGGLVQPGGSLRLSCAASGFSISSSSIHWVRQAPGKGLEWVAYISPSSGSTSYADSVKGRFTISADT
SKNTAYLQMNSLRAEDTAVYYCSRYYSSSYYYSYYYAMDYWGQGTLVTVSSASTKGPSVFPLAPSSKSTSGGTA
ALGCLVKDYFPEPVTVSWNSGALTSGVHTFPAVLQSSGLYSLSSVVTVPSSSLGTQTYICNVNHKPSNTKVDKK
VEPKSCDKTH

ANTI-VEGF ANTIBODIES

CROSS REFERENCE TO RELATED APPLICATIONS

This application is a continuation of U.S. patent application Ser. No. 11/342,249, which was filed on Jan. 27, 2006, which is a continuation of International Application No. PCT/US2004/024662, filed Jul. 30, 2004, which application claims benefit from U.S. Provisional Application Nos. 60/491,877, filed Aug. 1, 2003; 60/516,495, filed Nov. 1, 2003; 60/570,912, filed May 12, 2004; 60/571,239, filed May 13, 2004; 60/576,315, filed Jun. 1, 2004; and 60/580,757, filed Jun. 18, 2004, all of these applications are hereby incorporated by reference.

REFERENCE TO A COMPUTER PROGRAM LISTING APPENDIX

A Sequence Listing is provided in this patent document as a txt file entitled, "50474_016008_Sequence_Listing.txt," created Apr. 2, 2009 (size: 722 KB).

The content of this file is herein incorporated by reference.

FIELD OF THE INVENTION

This invention relates generally to anti-VEGF selected polypeptide sequences and antibodies with beneficial properties for research, therapeutic and diagnostic purposes.

BACKGROUND OF THE INVENTION

Angiogenesis and VEGF

Angiogenesis is an important cellular event in which vascular endothelial cells proliferate, prune and reorganize to form new vessels from preexisting vascular network. There are compelling evidences that the development of a vascular supply is essential for normal and pathological proliferative processes (Folkman and Klagsbrun (1987) Science 235:442-447). Delivery of oxygen and nutrients, as well as the removal of catabolic products, represent rate-limiting steps in the majority of growth processes occurring in multicellular organisms. Thus, it has been generally assumed that the vascular compartment is necessary, albeit but not sufficient, not only for organ development and differentiation during embryogenesis, but also for wound healing and reproductive functions in the adult.

Angiogenesis is also implicated in the pathogenesis of a variety of disorders, including but not limited to, proliferative retinopathies, age-related macular degeneration, tumors, rheumatoid arthritis (RA), and psoriasis. Angiogenesis is a cascade of process consisting of 1) degradation of the extracellular matrix of a local venue after the release of protease, 2) proliferation of capillary endothelial cells, and 3) migration of capillary tubules toward the angiogenic stimulus. Ferrara et al. (1992) Endocrine Rev. 13:18-32.

In view of the remarkable physiological and pathological importance of angiogenesis, much work has been dedicated to the elucidation of the factors capable of regulating this process. It is suggested that the angiogenesis process is regulated by a balance between pro- and anti-angiogenic molecules, and is derailed in various diseases, especially cancer. Carmeliet and Jain (2000) Nature 407:249-257.

Vascular endothelial cell growth factor (VEGF), a potent mitogen for vascular endothelial cells, has been reported as a pivotal regulator of both normal and abnormal angiogenesis. Ferrara and Davis-Smyth (1997) Endocrine Rev. 18:4-25; Ferrara (1999) J. Mol. Med. 77:527-543. Compared to other growth factors that contribute to the processes of vascular formation, VEGF is unique in its high specificity for endothelial cells within the vascular system. Recent evidence indicates that VEGF is essential for embryonic vasculogenesis and angiogenesis. Carmeliet et al. (1996) Nature 380:435-439; Ferrara et al. (1996) Nature 380:439-442. Furthermore, VEGF is required for the cyclical blood vessel proliferation in the female reproductive tract and for bone growth and cartilage formation. Ferrara et al. (1998) Nature Med. 4:336-340; Gerber et al. (1999) Nature Med. 5:623-628.

In addition to being an angiogenic factor in angiogenesis and vasculogenesis, VEGF, as a pleiotropic growth factor, exhibits multiple biological effects in other physiological processes, such as endothelial cell survival, vessel permeability and vasodilation, monocyte chemotaxis and calcium influx. Ferrara and Davis-Smyth (1997), supra. Moreover, recent studies have reported mitogenic effects of VEGF on a few non-endothelial cell types, such as retinal pigment epithelial cells, pancreatic duct cells and Schwann cells. Guerrin et al. (1995) J. Cell Physiol. 164:385-394; Oberg-Welsh et al. (1997) Mol. Cell. Endocrinol. 126:125-132; Sondell et al. (1999) J. Neurosci. 19:5731-5740.

Substantial evidence also implicates VEGF's critical role in the development of conditions or diseases that involve pathological angiogenesis. The VEGF mRNA is overexpressed by the majority of human tumors examined (Berkman et al. J. Clin Invest 91:153-159 (1993); Brown et al. Human Pathol. 26:86-91 (1995); Brown et al. Cancer Res. 53:4727-4735 (1993); Mattern et al. Brit. J. Cancer. 73:931-934 (1996); and Dvorak et al. Am J. Pathol. 146:1029-1039 (1995)). Also, the concentration of VEGF in eye fluids are highly correlated to the presence of active proliferation of blood vessels in patients with diabetic and other ischemia-related retinopathies (Aiello et al N. Engl. J. Med. 331:1480-1487 (1994)). Furthermore, recent studies have demonstrated the localization of VEGF in choroidal neovascular membranes in patients affected by AMD (Lopez et al. Invest. Ophtalmo. Vis. Sci. 37:855-868 (1996)).

The recognition of VEGF as a primary regulator of angiogenesis in pathological conditions has led to numerous attempts to block VEGF activities. Inhibitory anti-VEGF receptor antibodies, soluble receptor constructs, antisense strategies, RNA aptamers against VEGF and low molecular weight VEGF receptor tyrosine kinase (RTK) inhibitors have all been proposed for use in interfering with VEGF signaling (Siemeister et al. Cancer Metastasis Rev. 17:241-248 (1998). Indeed, anti-VEGF neutralizing antibodies have been shown to suppress the growth of a variety of human tumor cell lines in nude mice (Kim et al. Nature 362:841-844 (1993); Warren et al. J. Clin. Invest. 95:1789-1797 (1995); Borgström et al. Cancer Res. 56:4032-4039 (1996); and Melnyk et al. Cancer Res. 56:921-924 (1996)) and also inhibit intraocular angiogenesis in models of ischemic retinal disorders (Adamis et al. Arch. Ophthalmol. 114:66-71 (1996)). Therefore, anti-VEGF monoclonal antibodies or other inhibitors of VEGF action are promising candidates for the treatment of solid tumors and various intraocular neovascular disorders. Although the VEGF molecule is upregulated in tumor cells, and its receptors are upregulated in tumor infiltrated vascular endothelial cells, the expression of VEGF and its receptors remain low in normal cells that are not associated with angiogenesis.

Therapeutic Antibodies

Monoclonal antibodies can be manufactured using recombinant DNA technology. Widespread use has been made of monoclonal antibodies, particularly those derived from rodents, however nonhuman antibodies are frequently antigenic in humans. The art has attempted to overcome this problem by constructing "chimeric" antibodies in which a nonhuman antigen-binding domain is coupled to a human constant domain (Cabilly et al., U.S. Pat. No. 4,816,567). The isotype of the human constant domain may be selected to tailor the chimeric antibody for participation in antibody-dependent cellular cytotoxicity (ADCC) and complement-dependent cytotoxicity. In a further effort to resolve the antigen binding functions of antibodies and to minimize the use of heterologous sequences in human antibodies, humanized antibodies have been generated for various antigens in which substantially less than an intact human variable domain has been substituted at regions by the corresponding sequence from a non-human species. For example, rodent (CDR) residues have been substituted for the corresponding segments of a human antibody. In practice, humanized antibodies are typically human antibodies in which some complementarity determining region (CDR) residues and possibly some framework region (FR) residues are substituted by residues from analogous sites in rodent antibodies. Jones et al., Nature 321:522-525 (1986); Riechmann et al., Nature 332:323-327 (1988); Verhoeyen et al., Science 239:1534-1536 (1988).

Several humanized anti-human VEGF antibodies have been successfully generated, and have shown significant huVEGF-inhibitory activities both in vitro and in vivo. Presta et al. (1997) *Cancer Research* 57:4593-4599; Chen et al. (1999) *J. Mol. Biol.* 293:865-881. One specific humanized anti-VEGF antibody, the Avastin™ antibody, is currently used in several clinical trials for treating various solid tumors; and another high-affinity variant of the humanized anti-VEGF antibody is currently clinically tested for treating choroidal neovascularization related age macular degeneration (AMD).

Prior to administering a therapeutic antibody to human, preclinical studies in nonhuman mammals are generally desired to evaluate the efficacy and/or toxicity of the antibody. Ideally, the antibodies subject to these studies are capable of recognizing and reacting with high potency to a target antigen endogenous to the host animal such as mouse or nonhuman primate.

Phage Display

Phage display technology has provided a powerful tool for generating and selecting novel proteins that bind to a ligand, such as an antigen. Using the technique of phage display, large libraries of protein variants can be generated and rapidly sorted for those sequences that bind to a target antigen with high affinity. Nucleic acids encoding variant polypeptides are fused to a nucleic acid sequence encoding a viral coat protein, such as the gene III protein or the gene VIII protein. Monovalent phage display systems where the nucleic acid sequence encoding the protein or polypeptide is fused to a nucleic acid sequence encoding a portion of the gene III protein have been developed. (Bass, S., *Proteins*, 8:309 (1990); Lowman and Wells, *Methods: A Companion to Methods in Enzymology*, 3:205 (1991)). In a monovalent phage display system, the gene fusion is expressed at low levels and wild type gene III proteins are also expressed so that infectivity of the particles is retained. Methods of generating peptide libraries and screening those libraries have been disclosed in many patents (e.g., U.S. Pat. No. 5,723,286, U.S. Pat. No. 5,432,018, U.S. Pat. No. 5,580,717, U.S. Pat. No. 5,427,908 and U.S. Pat. No. 5,498,530).

The demonstration of expression of peptides on the surface of filamentous phage and the expression of functional antibody fragments in the periplasm of *E. coli* was important in the development of antibody phage display libraries. (Smith et al., *Science* (1985), 228:1315; Skerra and Pluckthun, *Science* (1988), 240:1038). Libraries of antibodies or antigen binding polypeptides have been prepared in a number of ways including by altering a single gene by inserting random DNA sequences or by cloning a family of related genes. Methods for displaying antibodies or antigen binding fragments using phage display have been described in U.S. Pat. Nos. 5,750,373, 5,733,743, 5,837,242, 5,969,108, 6,172,197, 5,580,717, and 5,658,727. The library is then screened for expression of antibodies or antigen binding proteins with desired characteristics.

Phage display technology has several advantages over conventional hybridoma and recombinant methods for preparing antibodies with the desired characteristics. This technology allows the development of large libraries of antibodies with diverse sequences in less time and without the use of animals. Preparation of hybridomas or preparation of humanized antibodies can easily require several months of preparation. In addition, since no immunization is required, phage antibody libraries can be generated for antigens which are toxic or have low antigenicity (Hogenboom, Immunotechniques (1988), 4:1-20). Phage antibody libraries can also be used to generate and identify novel therapeutic antibodies.

Phage display libraries have been used to generate human antibodies from immunized, non-immunized humans, germ line sequences, or naïve B cell Ig repertoires (Barbas & Burton, Trends Biotech (1996), 14:230; Griffiths et al., EMBO J. (1994), 13:3245; Vaughan et al., Nat. Biotech. (1996), 14:309; Winter EP 0368 684 B1). Naïve, or nonimmune, antigen binding libraries have been generated using a variety of lymphoidal tissues. Some of these libraries are commercially available, such as those developed by Cambridge Antibody Technology and Morphosys (Vaughan et al. (1996) Nature Biotech 14:309; Knappik et al. (1999) J. Mol. Biol. 296:57). However, many of these libraries have limited diversity.

The ability to identify and isolate high affinity antibodies from a phage display library is important in isolating novel antibodies for therapeutic use. Isolation of high affinity antibodies from a library is dependent on the size of the library, the efficiency of production in bacterial cells and the diversity of the library. See, for e.g., Knappik et al., J. Mol. Biol. (1999), 296:57. The size of the library is decreased by inefficiency of production due to improper folding of the antibody or antigen binding protein and the presence of stop codons. Expression in bacterial cells can be inhibited if the antibody or antigen binding domain is not properly folded. Expression can be improved by mutating residues in turns at the surface of the variable/constant interface, or at selected CDR residues. (Deng et al., J. Biol. Chem. (1994), 269:9533, Ulrich et al., PNAS (1995), 92:11907-11911; Forsberg et al., J. Biol. Chem. (1997), 272:12430). The sequence of the framework region is a factor in providing for proper folding when antibody phage libraries are produced in bacterial cells.

Generating a diverse library of antibodies or antigen binding proteins is also important to isolation of high affinity antibodies. Libraries with diversification in limited CDRs have been generated using a variety of approaches. See, for e.g., Tomlinson, Nature Biotech. (2000), 18:989-994. CDR3 regions are of interest in part because they often are found to participate in antigen binding. CDR3 regions on the heavy chain vary greatly in size, sequence and structural conformation.

Others have also generated diversity by randomizing CDR regions of the variable heavy and light chains using all 20 amino acids at each position. It was thought that using all 20 amino acids would result in a large diversity of sequences of variant antibodies and increase the chance of identifying novel antibodies. (Barbas, *PNAS* 91:3809 (1994); Yelton, D E, *J. Immunology*, 155:1994 (1995); Jackson, J. R., *J. Immunology*, 154:3310 (1995) and Hawkins, R E, *J. Mol. Biology*, 226:889 (1992)).

There have also been attempts to create diversity by restricting the group of amino acid substitutions in some CDRs to reflect the amino acid distribution in naturally occurring antibodies. See, Garrard & Henner, *Gene* (1993), 128: 103; Knappik et al., *J. Mol. Biol.* (1999), 296:57. However, these attempts have had varying success and have not been applied in a systematic and quantitative manner. Creating diversity in the CDR regions while minimizing the number of amino acid changes has been a challenge.

SUMMARY OF THE INVENTION

The present invention provides novel antibodies and polypeptide sequences. The present invention also provides antibodies capable of binding to rodent VEGF and human VEGF with Kd values within 10 fold of each value and are capable of inhibiting the binding of VEGF to a VEGF receptor. According to one embodiment, the antibody is capable of binding to either one or both of a Gly88Ala (G88A) or a Gly88Ser (G88S) human VEGF mutant with a Kd value that is within 10 fold of the Kd value of unmutated human VEGF.

The present invention provides antibodies that are capable of binding to a human VEGF and a mouse VEGF with Kd values that are 10 nM or less at 25° C. and are capable of inhibiting the binding of VEGF to a VEGF receptor. According to another embodiment the Kd values are 2 nM or less. According to another embodiment, the Kd values are 0.1 nM or less. According to another embodiment, an antibody of this invention binds VEGF with a Kd of no more than about 1 nM, or no more than about 500 pM.

The present invention also provides antibodies that are capable of binding to a human VEGF and to either one or both G88A and G88S mutants of human VEGF with Kd values that are 10 nM or less and are capable of inhibiting the binding of VEGF to a VEGF receptor. In another embodiment, the antibodies bind to a human VEGF and to either one or both human VEGF G88A and G88S mutants with Kd values that are 10 nM or less.

According to another embodiment, an antibody of this invention has an on-rate ($k_{on}$) for binding to human and/or mouse VEGF that is 1.0 or more ($10 \text{ M}^{-1} \text{ S}^{-1}$). According to another embodiment, the on-rate is 5.0 or more ($10 \text{ M}^{-1} \text{ S}^{-1}$). According to yet another embodiment, the on-rate is 10.0 or more ($10 \text{ M}^{-1} \text{ S}^{-1}$).

According to another embodiment, the antibodies of this invention contact less than 80% of the total surface area (angstrom$^2$) of G88 of human VEGF. According to another embodiment, the antibodies of this invention contact less than 70% of the total surface area (angstrom$^2$) of G88 of human VEGF. According to another embodiment, the antibodies of this invention contact less than 60% of the total surface area (angstrom$^2$) of G88 of human VEGF. According to another embodiment, the antibodies of this invention contact less than 1% of the total surface area (angstrom$^2$) of G88 of human VEGF. Such antibodies are generally capable of also binding mouse VEGF.

The VEGF receptor to be inhibited from binding to VEGF can be the VEGF receptor 1 (Flt-1), VEGF receptor 2 (KDR) or both receptors.

According to one embodiment, an antibody of this invention contacts the 20s helix of VEGF. According to another embodiment, an antibody of this invention contacts the 80s loop of VEGF. According to yet another embodiment, an antibody of this invention contacts the 20s helix and the 80s loop of human VEGF.

According to one embodiment, an antibody of this invention has relative affinity for or is capable of contacting any one of residues F17, M18, Q22, Y25, D63, L66, C104 and P106 of human VEGF. According to another embodiment, an antibody of this invention has relative affinity for or is capable of contacting F17, M18, Q22, Y25, D63, L66, C104 and P106 of human VEGF. According to another embodiment, an antibody of this invention has relative affinity for or is capable of contacting residues F17 and Y21 of human VEGF. According to another embodiment, an antibody of this invention has further relative affinity for or is capable of contacting Y25 of VEGF. According to another embodiment, an antibody of this invention has relative affinity for or is capable of contacting M18 and Q89 human VEGF. According to another embodiment, an antibody of this invention has relative affinity for or is capable of contacting M18, Y21 and Y25 of human VEGF. According to a preferred embodiment, an antibody of this invention has a combination of three or more of any one of the above-mentioned embodiments.

In a further embodiment, an antibody of this invention has a functional epitope described herein. According to one embodiment, the functional epitope of an antibody according to this invention includes residue F17 of human VEGF. According to another embodiment, the functional epitope of an antibody according to this invention includes residues F17 and I83 of human VEGF. According to a further embodiment, the functional epitope of includes residues F17, I83 and Q89 of human VEGF. According to one embodiment, the functional epitope of an antibody according to this invention includes residues F17 and M18 of human VEGF. In a further embodiment, the functional epitope includes residues F17, M18 and I89 of human VEGF. According to one embodiment, the functional epitope of an antibody according to this invention includes residues F17, Y21 and Y25 of human VEGF. According to a further embodiment, the functional epitope includes residues F17, Y21, Q22, Y25, D63 and I83 of human VEGF. According to an alternative embodiment, the functional epitope includes residues F17, Y21, Y25 and Q89 of human VEGF. According to a further embodiment, the functional epitope includes residues F17, M18, D19, Y21, Y25, Q89, I91, K101, E103, and C104 of human VEGF. According to yet another embodiment, the functional epitope includes residues F17, Y21, Q22, Y25, D63, I83 and Q89 of human VEGF. A functional epitope of an antibody according to this invention can include a combination of any of the residues selected from the group consisting of F17, M18, Y21, Q22, Y25, K48, D63, L66, M81, I83, H86, Q89, I91, C104 and P106 of human VEGF. According to another embodiment, the functional epitope includes residues F17, M18, Y21, Q22, Y25, K48, D63, L66, M81, I83, H86, Q89, I91, C104 and P106 of human VEGF.

According to one embodiment, an antibody of this invention comprises a CDR-H3 comprising the contiguous amino acid sequence $X_1X_2FX_4X_5X_6X_7$ (SEQ ID NO: 915), wherein $X_1$ is Y or F;
$X_2$ is V or A;
$X_4$ is F or Y;
$X_5$ is L or A;
$X_6$ is P or A; and
$X_7$ is Y or F.

According to another embodiment, the antibody further comprises a CDR-H2 having a contiguous amino acid sequence $GX_2TPX_5G$ (SEQ ID NO: 1), wherein $X_2$ is a I or V or other hydrophobic amino acid; and
$X_5$ is any amino acid residue.

According to yet another embodiment, the antibody still further comprises a CDR-H1 having a contigous amino acid sequence $X_1X_2X_{3z}IH$ (SEQ ID NO: 2), wherein $X_1$ is any amino acid residue;
$X_2$ is Y or F; and
$X_3$ is W or L.

According to one preferred embodiment, the antibody further comprises the CDR-L1, CDR-L2 and CDR-L3 of any one of the antibodies of FIG. 7. According to another embodiment, the CDR-L1 is located at approximately residues 28-33, the CDR-L2 is located at approximately residues 50-55; and the CDR-L3 is located at approximately residues 91-96. According to another embodiment, the CDR-H1 is located at approximately residues 30-33, the CDR-H2 is located at approximately residues 50-58; and the CDR-L3 is located at approximately residues 94-100a. According to one preferred embodiment, the antibody comprises the framework regions of the G6 antibody, the G6-23 antibody or the G6-31 antibody. According to another embodiment, the antibody comprises the light chain CDRs or the light chain variable region of the G6 antibody, the G6-23 antibody or the G6-31 antibody.

According to one embodiment, an antibody of this invention is an antibody comprising:

(a) a CDR-L1 comprising the contiguous amino acid sequence $X_1X_2X_3X_4X_5L$ (SEQ ID NO: 916), wherein:

$X_1$ and $X_2$ are any amino acid;
Either $X_3$ or $X_4$ or both $X_3$ and $X_4$ are R;
$X_5$ is S or A; and (b) a CDR-L2 comprising a contiguous amino acid sequence $X_1X_2X_3$ (SEQ ID NO: 917), wherein $X_1$ is S or A or G; and
$X_2$ and $X_3$ is any amino acid residue; and (c) a CDR-L3 comprising a contigous amino acid sequence $SX_1X_2X_3PL$ (SEQ ID NO: 918), wherein $X_1$ and $X_2$ are any amino acid residue; and
$X_3$ is S or A.

According to one preferred embodiment, the antibody comprises the framework regions of the B20-4.1 antibody or the B20-4 antibody. According to another embodiment, the antibody comprises the CDRs or the variable region of the B20 heavy chain variable region. According to another embodiment, the $X_1X_2X_3$ (SEQ ID NO: 917) of the CDR-L2 is encoded by $X_1ASX_4LX_6$ (SEQ ID NO: 919), wherein $X_4$ and $X_6$ are any amino acid. According to another embodiment, the CDR-L1 is located at approximately residues 28-33, the CDR-L2 is located at approximately residues 50-55; and the CDR-L3 is located at approximately residues 91-96. According to another embodiment, the CDR-H11 is located at approximately residues 30-33, the CDR-H2 is located at approximately residues 50-58; and the CDR-L3 is located at approximately residues 94-100a.

Also contemplated is an antibody comprising a CDR-H3 sequence of any one of the antibodies of FIGS. 2, 7, 24-29 and 34-43 and optionally further comprising a CDR-H2 and/or a CDR-H1 of the same antibody from FIGS. 2, 7, 24-29 and 34-43. Also, contemplated is an antibody selected from the group consisting of a G6 series antibody, a B20 series antibody, YADS series antibody and a YS series antibody. Further, another antibody of this invention is an antibody comprising a variable region of any one of the antibodies of FIGS. 2, 7, 24-29 and 34-43.

According to one preferred embodiment, the antibodies of this invention are synthesized by recombinant methods rather than produced directly from a hybridoma or derived from an antibody sequence from a hybridoma. In one preferred embodiment, the antibody binds to hVEGF with a Kd value of no more than about 2 nM, no more than about 1 nM, or no more than about 500 pM. According to one embodiment, antibody is a monoclonal antibody. According to another embodiment, the antibody is a multi-specific antibody (e.g., a bispecific antibody).

In a further embodiment of the invention, the high affinity anti-hVEGF antibody is also capable of binding to a VEGF from a non-human mammal species with Kd values comparible to, or at least within ten-fold of, the Kd value for its hVEGF binding. Such antibodies with cross-species high binding affinities are particularly useful for preclinical research as well as diagnostic and therapeutic applications. Some of the antibodies intended for therapeutic use were generated using a target human antigen as the immunogen. The resultant antibody may be "species-dependent", i.e. while binding specifically to human antigen, it may be much less effective at binding a homologue of that antigen from a nonhuman mammal. This is found herein to be problematic, particularly where the nonhuman mammal is one in which preclinical studies of the antibody are to be carried out. An example is the anti-VEGF antibody, the Avastin™ antibody, used for treating cancers. While the Avastin™ antibody had a strong binding affinity for human VEGF (i.e. $K_d$ 1.8 nM), the affinity for murine VEGF was unsuitable for conducting experiments in mouse models.

In one aspect, the antibodies are synthetic antibodies comprising at least one variant CDR in its variable domains, wherein the variant CDR comprises variant amino acid in at least one solvent accessible and highly diverse amino acid position, wherein the variant amino acid is encoded by a nonrandom codon set, and wherein at least 70% of the amino acids encoded by the nonrandom set are target amino acids for that position in known antibody variable domains. The antibody may have a heavy chain variable domain which comprises at least 1, 2 or 3 variant CDRs selected from the group consisting of CDR H1, H2 and H3. Preferably the heavy chain variable domain comprises a variant CDR H3. The antibody may also have a light chain variable domain which comprises at least 1, 2 or 3 variant CDRs selected from the group consisting of CDR L1, L2 and L3.

According to another embodiment, an antibody of this invention binds human VEGF and a rodent VEGF with a desired affinity but does not bind to any one or all of the VEGF-related homologues selected from the group consisting of human VEGF-B, human VEGF-D, and human PlGF-2.

According to one preferred embodiment, an antibody of this invention has a combination of three or more of any one of the above-mentioned embodiments. According to another embodiment, a Fab antibody of this invention is conjugated to an agent will increase the half-life of the Fab antibody. According to one preferred embodiment, the agent is a polypeptide comprising the sequence DICLPRWGCLW (SEQ ID NO:935). In a preferred embodiment, the antibodies of this invention do not bind to PlGF, VEGF-D or VEGF-B.

The invention also provide a method of selecting a hVEGF antibody from a library of synthetic antibodies comprising: a) generating the library of synthetic antibodies having a designed diversity in at least one of the CDRs; b) contacting the library with hVEGF to form binders; c) separating the binders from the nonbinders, and eluting the binders from the target hVEGF and incubating the binders in a solution with decreasing amounts of the target hVEGF in a concentration from about 0.1 nM to 1000 nM; and d) selecting the binders that can bind to the lowest concentration of the target VEGF and that have an affinity of about 500 pM to 2 nM.

Also contemplated are variants of the synthetic antibodies with improved binding affinities to hVEGF or to VEGF of non-human species, or both. Various forms of the antibody and variants thereof are contemplated herein. For example, the antibody mutant may be a full length antibody (e.g. having a human immunoglobulin constant region) or an antibody fragment (e.g. a Fab or F(ab')$_2$). Furthermore, the antibody mutant may be labeled with a detectable label, immobilized on a solid phase and/or conjugated with a heterologous compound (such as a cytotoxic agent).

Diagnostic and therapeutic uses for the antibody are contemplated. In one diagnostic application, the invention provides a method for determining the presence of a protein of interest comprising exposing a sample suspected of containing the protein to the antibody mutant and determining binding of the antibody mutant to the sample. For this use, the invention provides a kit comprising the antibody mutant and instructions for using the antibody mutant to detect the protein.

The invention further provides: isolated nucleic acid encoding the antibody; a vector comprising the nucleic acid, optionally, operably linked to control sequences recognized by a host cell transformed with the vector; a host cell transformed with the vector; a process for producing the antibody comprising culturing this host cell so that the nucleic acid is expressed and, optionally, recovering the antibody mutant from the host cell culture (e.g. from the host cell culture medium).

The invention also provides a composition comprising the antibody and a pharmaceutically acceptable carrier or diluent. This composition for therapeutic use is sterile and may be lyophilized. Also contemplated is the use of an antibody or polypeptide of this invention in the manufacture of a medicament for treating an indication described herein. The composition can further comprise a second thereapeutic agent such as a chemotherapeutic agent, a cytotoxic agent or an anti-angiogenic agent.

The invention further provides a method for treating a mammal, comprising administering an effective amount of the antibody to the mammal. The mammal to be treated in the method may be a nonhuman mammal, e.g. a primate suitable for gathering preclinical data or a rodent (e.g., mouse or rat or rabbit). The nonhuman mammal may be healthy (e.g. in toxicology studies) or may be suffering from a disorder to be treated with the antibody of interest. In one embodiment, the mammal is suffering from or is at risk of developing abnormal angiogenesis (e.g., pathological angiogenesis). In one specific embodiment, the disorder is a cancer selected from the group consisting of colorectal cancer, renal cell carcinoma, ovarian cancer, lung cancer, non-small-cell lung cancer (NSCLC), bronchoalveolar carcinoma and pancreatic cancer. In another embodiment, the disorder is a disease caused by ocular neovascularisation, e.g., diabetic blindness, retinopathies, primarily diabetic retinopathy, age-induced macular degeneration and rubeosis. In another embodiment, the mammal to be treated is suffering from or is at risk of developing an edema (e.g., an edema associated with brain tumors, an edema associated with stroke, or a cerebral edema). In another embodiment, the mammal is suffering from or at risk of developing a disorder or illness selected from the group consisting of rheumatoid arthritis, inflammatory bowel disease, refractory ascites, psoriasis, sarcoidosis, arterial arteriosclerosis, sepsis, burns and pancreatitis. According to another embodiment, the mammal is suffering from or is at risk of developing a genitourinary illness selected from the group consisting of polycystic ovarian disease (POD), endometriosis and uterine fibroids. The amount of antibody administered will be a therapeutically effective amount to treat the disorder. In dose escalation studies, a variety of doses of the antibody may be administered to the mammal. In another embodiment, a therapeutically effective amount of the antibody is administered to a human patient to treat a disorder in that patient. In one preferred embodiment, antibodies of this invention useful for treating inflammatory or immune diseases described herein (e.g., rheumatoid arthritis) are Fab or scFv antibodies, especially Fab or scFv antibodies derived from the G6 series of antibodies or the B20 series of antibodies. Antibodies that do not cause aggregation of VEGF and do not aggregate themselves such as the B20 series of IgG antibodies are particularly useful in treating inflammatory and immune diseases. Accordingly, such antibodies are can be can be used in the manufacture of a medicament for treating an inflammatory or immune disease. A mammal that is suffering from or is at risk for developing a disorder or illness described herein can be treated by administering, a second therapeutic agent, simultaneously, sequentially or in combination with, an antibody of this invention. It should be understood that other therapeutic agents, in addition to the second therapeutic agent, can be administered to the mammal or used in the manufacture of a medicament for the desired indications.

These antibodies and polypeptides can be used to understand the role of host stromal cell collaboration in the growth of implanted non-host tumors, such as in mouse models wherein human tumors have been implanted. These antibodies and polypeptides can be used in methods of identifying human tumors that can escape anti-VEGF treatment by observing or monitoring the growth of the tumor implanted into a rodent or rabbit after treatment with an anti-VEGF antibodies of this invention. The antibodies and polypeptides of this invention can also be used to study and evaluate combination therapies with anti-VEGF antibodies of this invention and other therapeutic agents. The antibodies and polypeptides of this invention can be used to study the role of VEGF in other diseases by administering the antibodies or polypeptides to an animal suffering from the disease of a similar disease and determining whether one or more symptoms of the disease are alleviated.

BRIEF DESCRIPTION OF THE DRAWINGS

FIG. 2 compares residue changes within heavy chain CDRs of the template antibody h4D5 and the four selected novel synthetic antibodies (SEQ ID NO: 921-928). Also compared are VEGF bindings of the four antibodies.

FIG. 6 shows effects of G6 on VEGF-induced HUVEC proliferation.

FIG. 7 illustrates steps of generating high affinity anti-VEGF antibodies and the list of residues and binding affinities related to various affinity-improved G6 variants (SEQ ID NO: 44-84).

FIG. 8 compares VEGF bindings of G6, G6-23 and Fab-12. Association rates (on-rate) to both hVEGF and mVEGF were measured over time; the calculated Kon, Koff and Kd are listed.

FIGS. 14A and B describe codons designed for shotgun scanning codons of G6 and G6-23. For each scan, degenerate shotgun codons for (A) heavy and (B) light chain were designed to encode the wild-type amino acid and alanine (m1) in alanine-scan or similar amino acid (m4) in homolog-scan for both G6 and G6-23 Fab. The shotgun codons are represented by the IUB code (K=G/T, M=A/C, R=A/G, S=G/C, V=A/C/G, W=A/T, Y=C/T). More substitutions (m2, m3, and m5) occurred in some residues due to the nature of the genetic code. In the case of wild-type alanine, the shotgun codon was designed to encode alanine and glycine. Each residue on CDRs is denoted by the single-letter code for amino acid, followed by a number denoting its position according to the scheme of Kabat et al., 1987. In positions where the sequences of G6 and G6-23 differ were shown in two letters, e.g. Q89K denotes position 89 which is Gln or Lys in G6 or G6-23, respectively. Asterisks(*) indicate both alanine- and homolog-scan codons encode a common substitution.

FIG. 15 provides information regarding the construction of G6 and G6-23 shotgun scanning libraries. The shotgun scanning libraries were performed to mutate codons for the indicated residues on the heavy (hc) or light (lc) chain of G6 and G6-23 with either alanine- or homolog-scan shotgun codons (FIGS. 14A and B). In total, eight libraries were constructed using the mutagenic oligonucleotides as shown in Example 1. The theoretical diversity of each library, total numbers of amino acid combinations encoded by the mutagenic oligonucleotides, was exceeded at least 100-fold by the actual diversity of the constructed library.

FIGS. 16A and B describe the results of the G6 and G6-23 heavy chain shotgun scan. The effect of each mutation (FIGS. 14A and B) on the heavy chain CDR residues of (A) G6 and (B) G6-23 was evaluated by calculating wt/mut ratios from sequences of functional clones, either from the alanine-scan libraries (m1, m2, and m3) or the homolog-scan libraries (m4 and m5), isolated after binding selection to either hVEGF (target selection) or an anti-gD tag antibody (display selection). To provide a quantitative estimate of the effect of each mutation on the binding affinity of G6 and G6-23 for hVEGF, the function ratio (Fwt/mut) at each mutation site was derived from dividing the wt/mut ratio from target selection by that from display selection. Deleterious effects are indicated by Fwt/mut values greater than 1.0, and mutations that result in significantly deleterious effects (Fwt/mut>10) are shown in bold text. Several mutations were not observed amongst the target selection and only a lower limit could be defined for its wt/mut ratio; therefore, the Fwt/mut value was indicated as a greater sign.

FIGS. 17A and B describe the results of the G6 and G6-23 light chain shotgun scan. The effect of each mutation (FIGS. 14A and B) on the light chain CDR residues of (A) G6 and (B) G6-23 was evaluated by calculating wt/mut ratios from sequences of functional clones, either from the alanine-scan libraries (m1, m2, and m3) or the homolog-scan libraries (m4 and m5), isolated after binding selection to either hVEGF (target selection) or an anti-gD tag antibody (display selection). To provide a quantitative estimate of the effect of each mutation on the binding affinity of G6 and G6-23 for hVEGF, the function ratio (Fwt/mut) at each mutation site was derived from dividing the wt/mut ratio from target selection by that from display selection. Deleterious effects are indicated by Fwt/mut values greater than 1.0, and mutations that result in significantly deleterious effects (Fwt/mut>10) are shown in bold text.

FIG. 18 is a comparison of relative binding activities for FabG6 and G6-23 point mutants to hVEGF with function values (Fwt/mut) from shotgun scanning. The relative binding activities of each mutant protein to hVEGF were evaluated with IC50, mut/IC50, wt ratio, a measure of the fold reduction in hVEGF binding activity due to each point mutation. The IC50, wt values for G6 and G6-23 are 2.5 nM and 20 pM respectively. The ratio without showing the standard error is estimated the error is ±5%. The ratios of significantly deleterious mutations could not be precisely quantitated because no inhibition was observed at the highest concentration of hVEGF (1 uM and 0.1 uM for G6 and G6-23 respectively) used in the assay and were only shown as a lower limit (>400 and >5000 for G6 and G6-23 mutants respectively) for fold reduction in hVEGF binding. The function values (Fwt/mut) of shotgun scanning were from FIGS. 16 and 17. DDG-mut-wt values for both mutagenesis scanning were calculated using the equation as indicated in the legend of FIGS. 22A and B.

FIG. 19 describes the relative binding affinities for as measured by phage ELISAs for phage-derived hVEGF$_{1-109}$ single alanine mutant to bind different versions of anti-hVEGF antibodies or hVEGF receptors (G6, G6-23, and B20-4 Fabs, monoclonal antibody A4.6.1 and receptors Flt-1 (1-3), Flt-1$_{D2}$ and KDR-Ig, respectively). The effects of phage-derived single alanine mutants of hVEGF on the binding affinity of anti-hVEGF antibody and hVEGF receptor were assessed as the relative IC50 values, which are calculated as IC$_{50,ala}$/ID$_{50,wt}$ from phage ELISAs. A number greater than 1.0 indicated reduction in binding affinity and any variant with significant relative IC50 values greater than 10 was highlighted as bold text. The IC5$_{0,wt}$ values for G6 and G6-23 are 2.5 nM and 20 pM respectively. The ratio without showing the standard error is estimated that the average error is ±5%. Because phage ELISAs required substantial binding of the mutant phagemid to its protein target to generate a measurable signal, non-binders (NB) could not be precisely quantitated but may be interpreted to have a greatly reduced binding affinity (greater than 1000 IC50 value). Asterick (*) indicated the alanine scanning data on hVEGF for Fab-12 and hVEGF receptors were from Muller et al., (1997) *PNAS USA* 94: 7192-7197 and Li et al., (2000) *Cancer Res.* 57:4593-4599.

FIGS. 20A and B describe results from the FabG6 and G6-23 heavy chain shotgun scan. Fwt/mut values measured the effects of FabG6 and G6-23 heavy chain CDRs alanine (black bars) or homolog (white bars) substitutions on binding affinity for hVEGF. Shotgun scanning data for (A) FabG6 heavy chain were from FIG. 16A, and for (B) FabG6-23 heavy chain were from FIG. 16B.

Figure 21A:
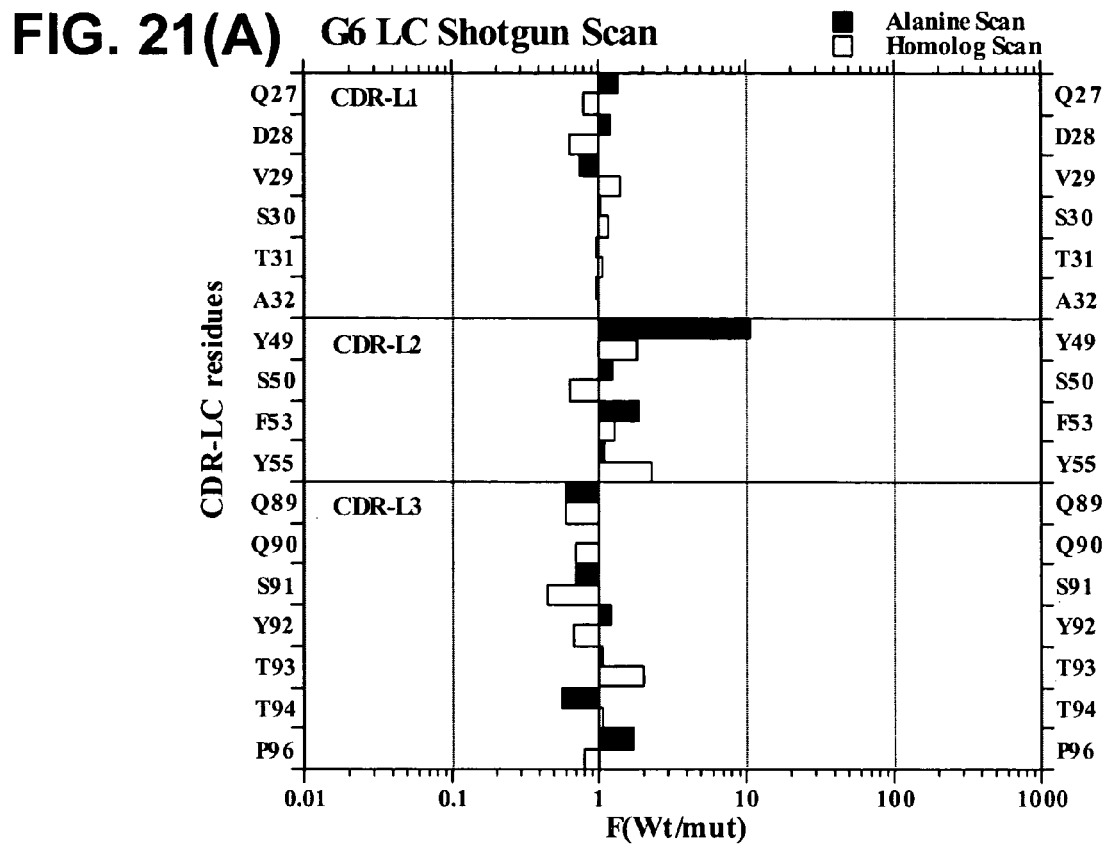
Figure 21B:
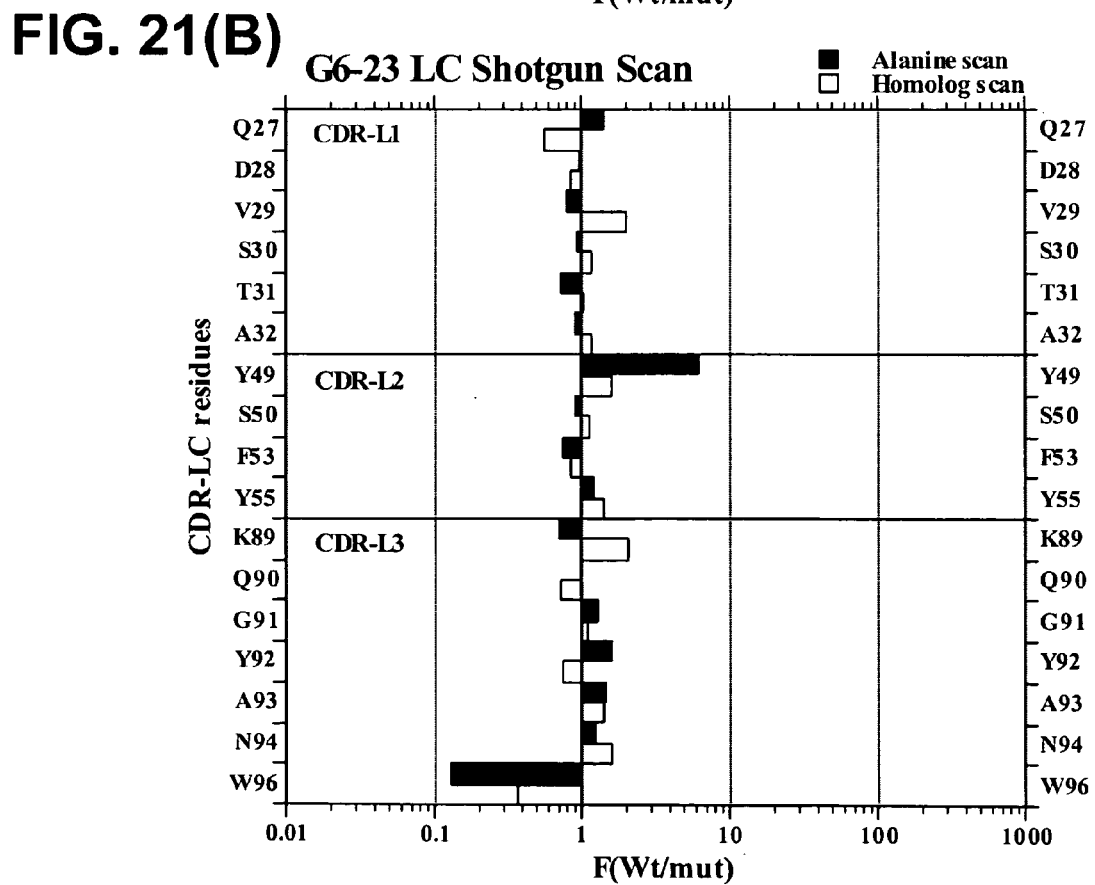

FIGS. 21A and B describe results from the FabG6 and G6-23 light chain shotgun scan. Fwt/mut values measured the effects of FabG6 and G6-23 light chain CDRs alanine (black bars) or homolog (white bars) substitutions on binding affinity for hVEGF. Shotgun scanning data for (A) FabG6 light chain were from FIG. 17A, and for (B) FabG6-23 light chain were from FIG. 17B.

FIGS. 22A and B report the DDGAla-wt values for the FabG6 and G6-23 shotgun scan. DDGAla-wt values measuring the effects of (A) FabG6 and (B) FabG6-23 CDRs alanine substitutions on binding affinity for hVEGF were calculated using biophysical equation (DDGAla-wt=RTln(Ka,wt/Ka,Ala)=RTln(Fwt/Ala)) as previously described (Weiss et al., (2000) *PNAS USA* 97:8950-8954) and Fwt/Ala values were from FIGS. 16 and 17.

Figure 23:
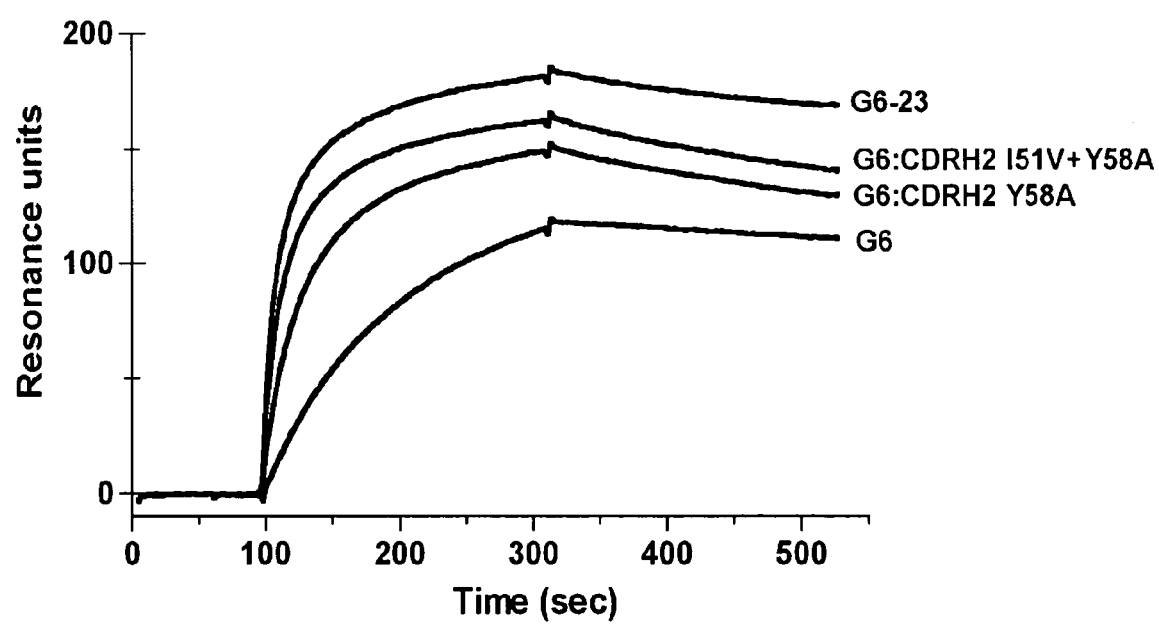

FIG. 23 describes the results of sensograms for injection of 100 nM Fab at 25° C. over hVEGF immobilized on BIAcore chip. It demonstrated the on-rate improvement for G6 variant with alanine substitution at position 58 of CDR-H2. Additional on-rate improvement also can be observed for this variant with valine substitution at position 51 of CDR-H2. This figure was generated using GraphPad Prism 4.0 version software (http://www.graphpad.com).

FIG. 24 shows the amino acid sequences of the G6 Fab light chain and the G6 Fab heavy chain, respectively (SEQ ID NO. 28-29). The underlines indicates residues in the CDR1-LC, CDR2-LC and CDR3-LC or CDR1-HC, CDR2-HC or CDR3-HC according to the Kabat numbering system.

FIG. 25 shows the amino acid sequence of the G6-23 Fab light chain and of the G6-23 Fab heavy chain as well as the amino acid sequences of the G6-31 and G6-8 Fab light chains (SEQ ID NO. 30-33). The underlines indicate the position of the CDRs according to the Kabat numbering system.

FIG. 26 shows the amino acid sequences the amino acid sequences of the G6-23.1 and G6-23.2 Fab light and heavy chains (SEQ ID NO. 34-36). The underlines indicate the position of the CDRs according to the Kabat numbering system.

FIG. 27 shows the amino acid sequence of the B20 Fab light and heavy chains (SEQ ID NO. 37-38). The underlines indicate the position of the CDRs according to the Kabat numbering system.

FIG. 28 shows a summary of high affinity binders of VEGF derived from a B20-based library (SEQ ID NO. 85-140).

FIG. 29 shows the amino acid sequence of the B20-4 and B20-4.1 Fab light and heavy chains (SEQ ID NO. 39-41).

Figure 30A:
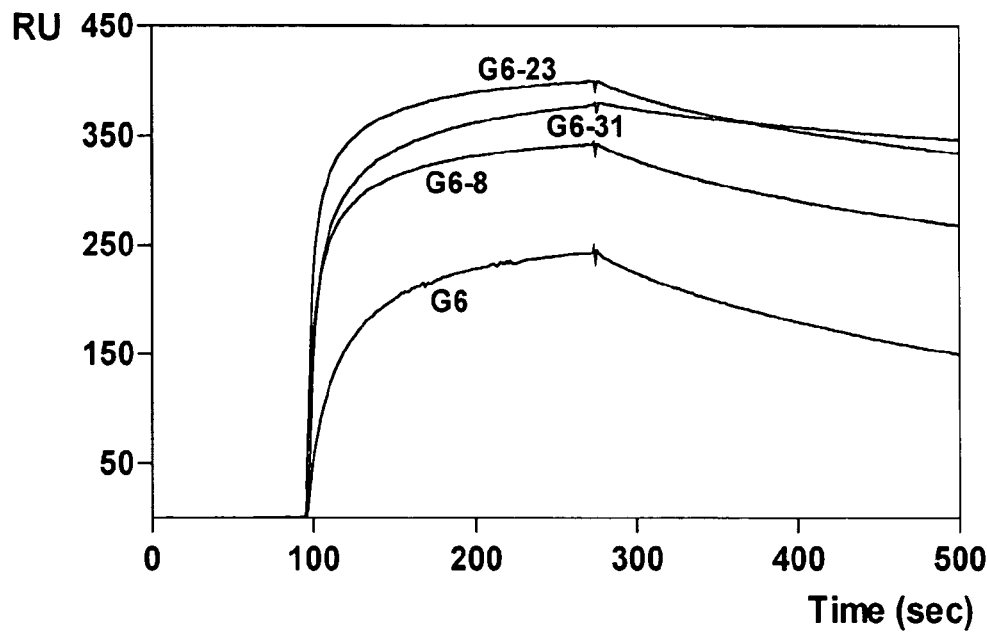
Figure 30B:
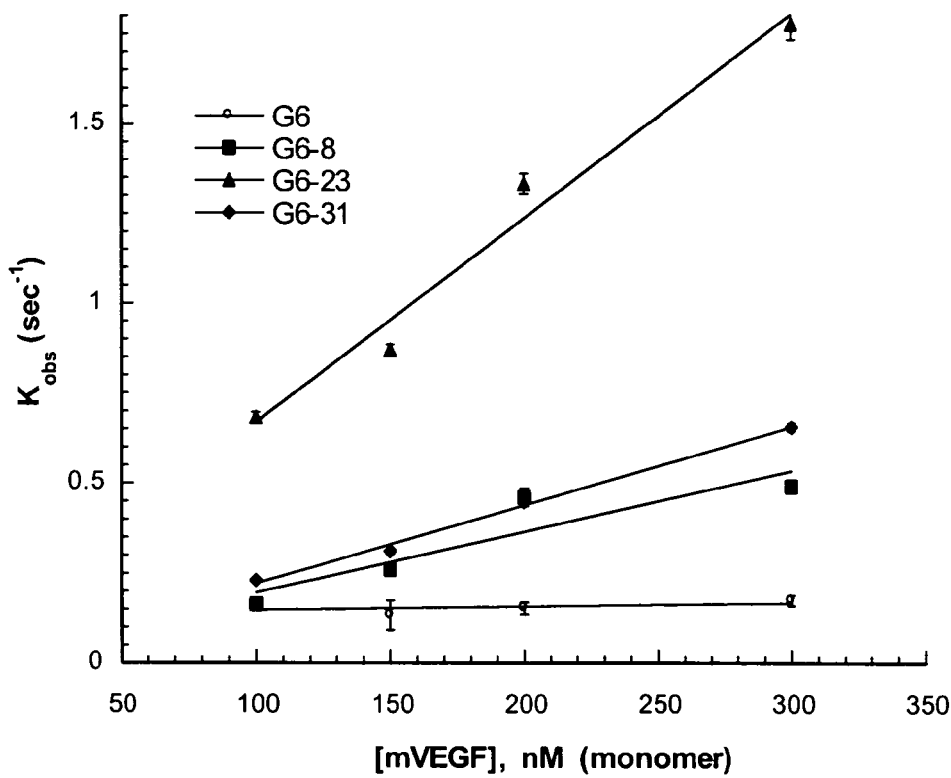

FIG. 30 shows the affinity improvement of the anti-mVEGF Fab G6 by light chain randomization. (A) the sensograms for injection of 500 nM Fab at 37° C. over mVEGF immobilized BIAcore chip demonstrate the off rate and on rate improvements; (B) the observed rate ($K_{obs}$, $s^{-1}$) of complex formation between G6 and variant Fabs and mVEGF as the rate of the decrease of fluorescence intensity was plotted against the concentrations of mVEGF (nM) used and the slope based on the pseudo-first-order analysis was the on rate ($\times 10^9$ $M^{-1}$ $s^{-1}$).

Figure 31A:
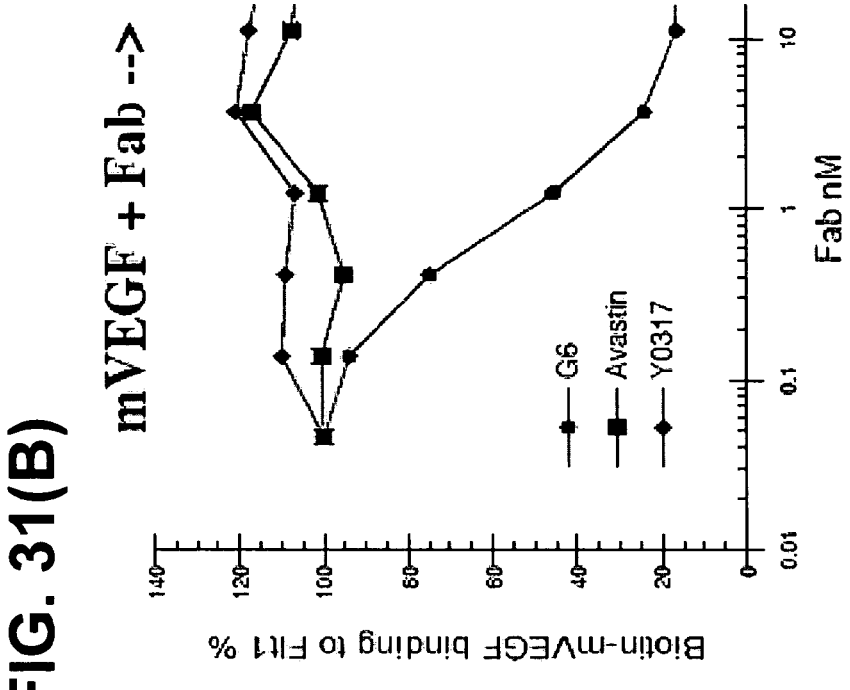
Figure 31B:
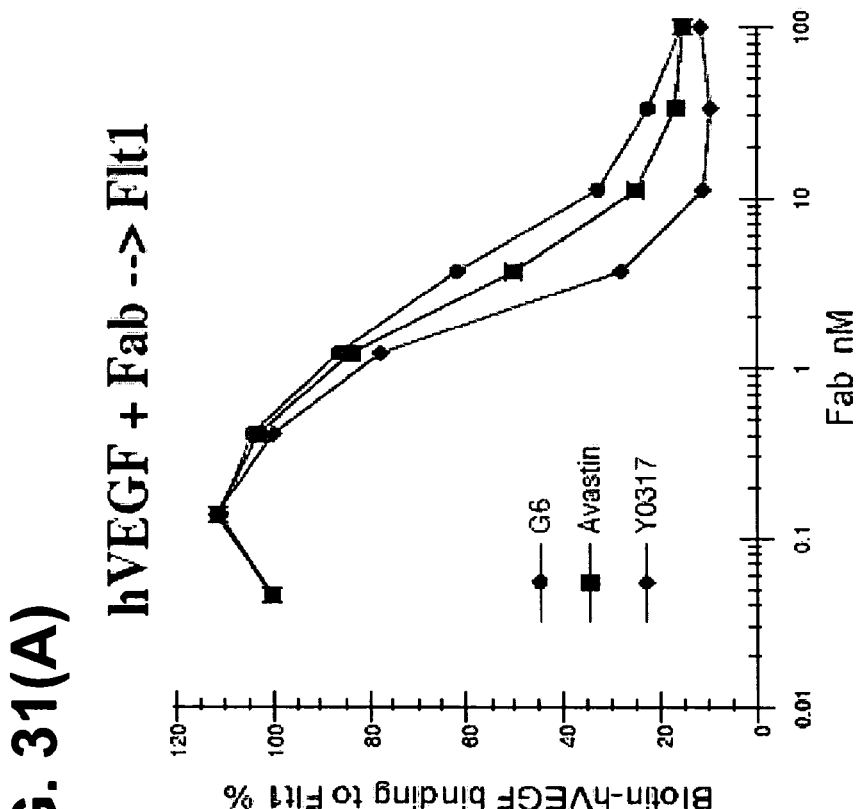
Figure 33B:
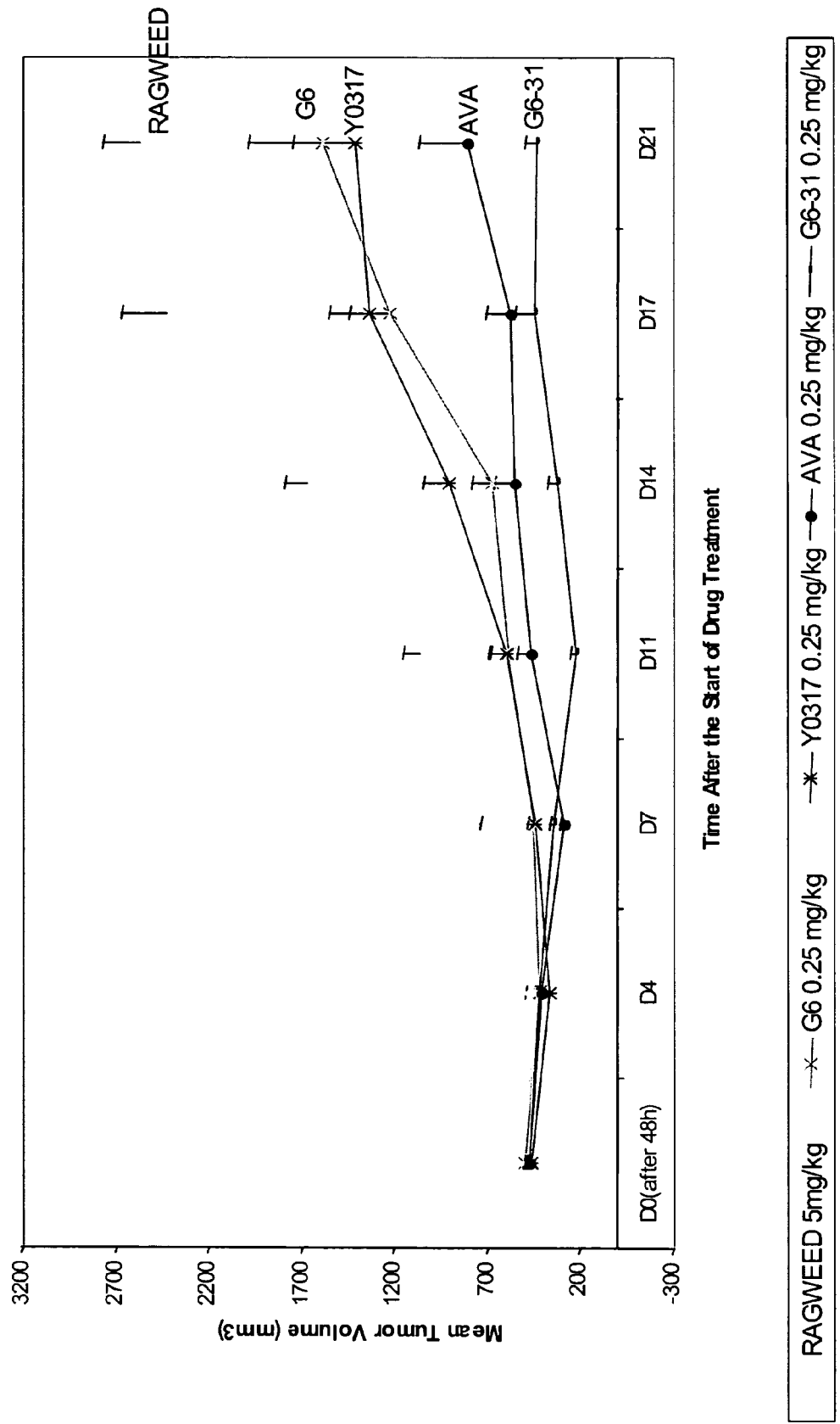
Figure 33C:
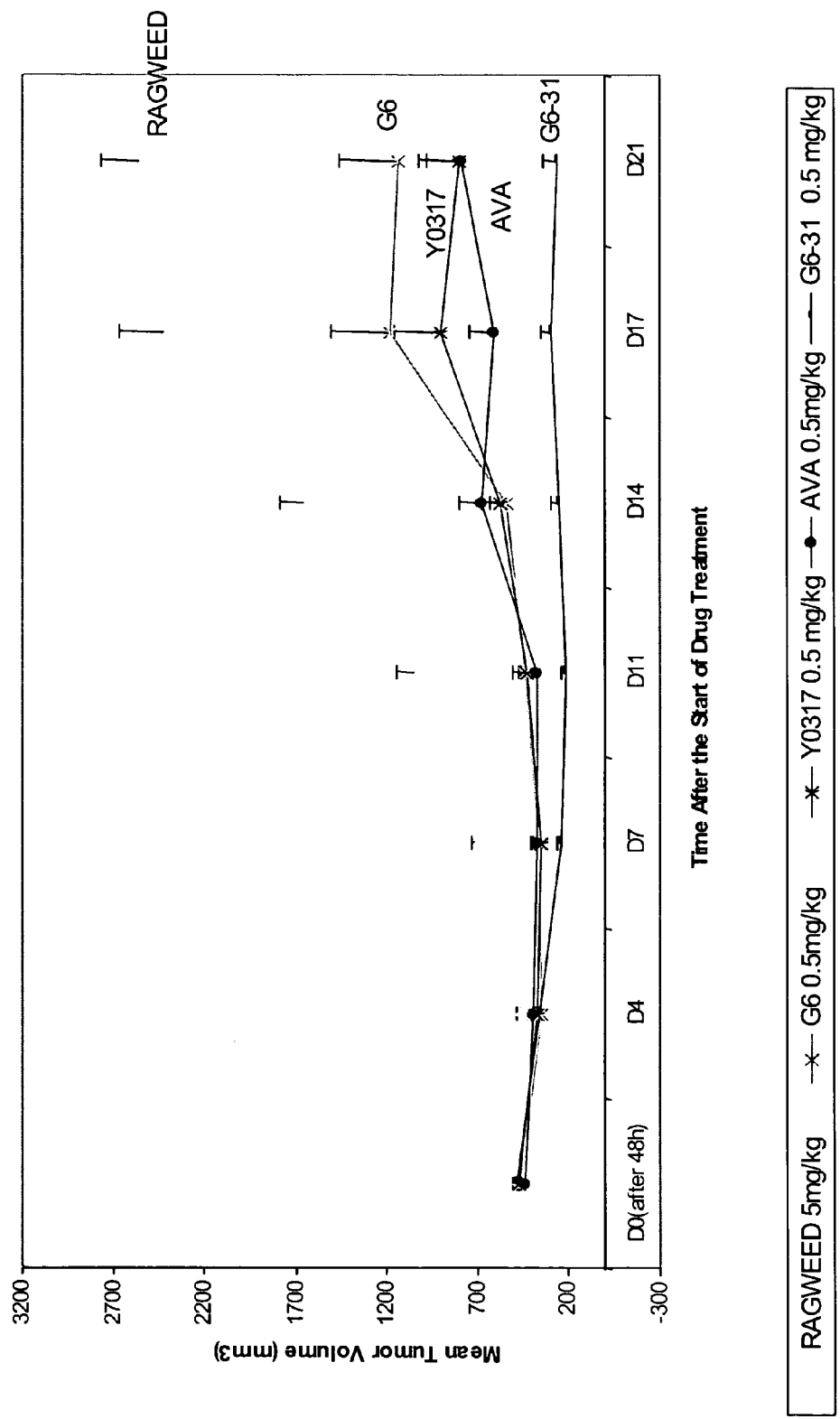
Figure 33D:
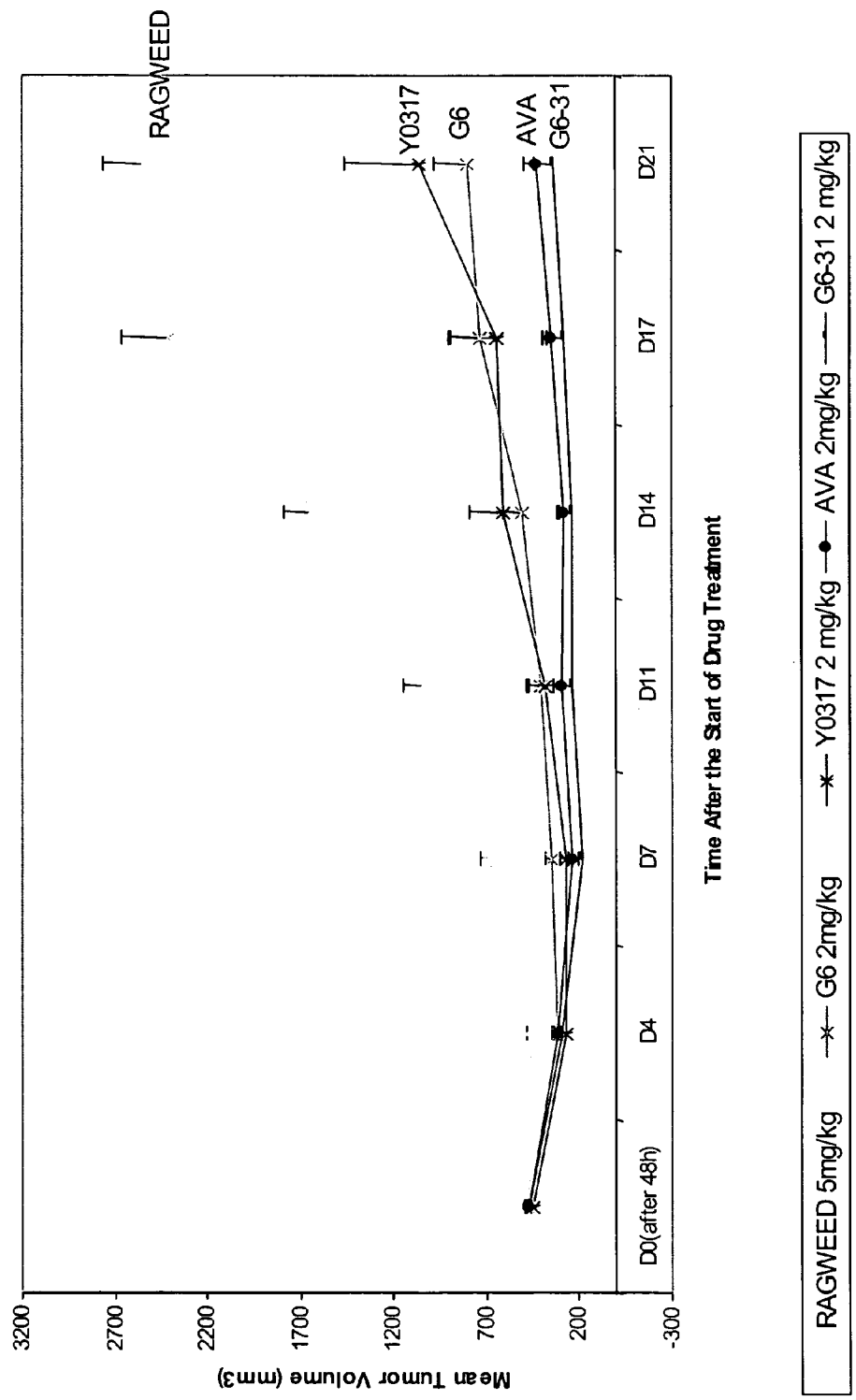
Figure 33E:
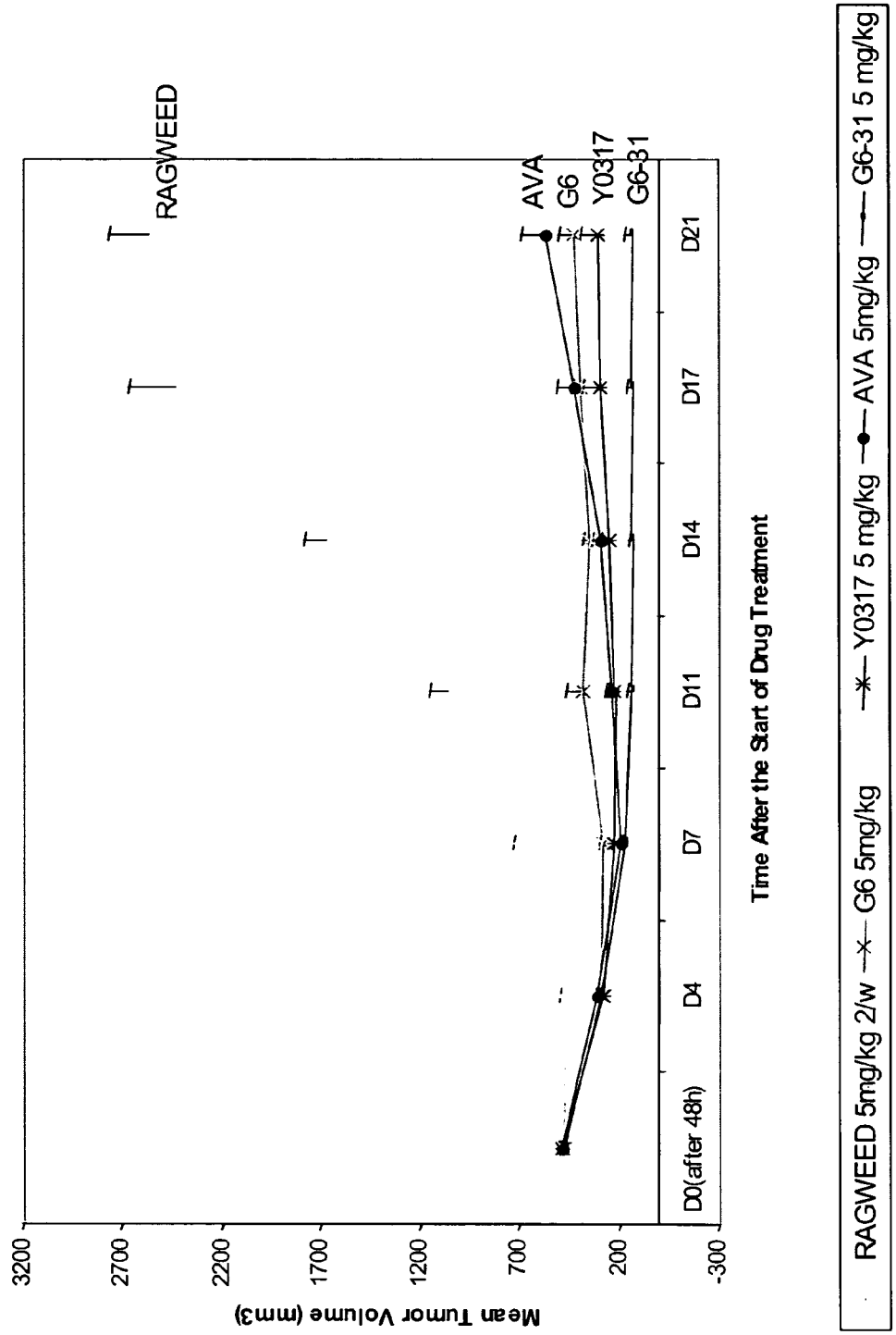

FIG. 31 shows that G6 can effectively block both hVEGF and mVEGF binding to Flt-1 receptor. Fab-12 and Y0317 were used as controls.

FIG. 32 shows on-rates, off-rates, Kd values and IC50 values for Fab protein-human VEGF or Fab protein-mouse VEGF interactions at 25° C. and 37° C. using surface plasmon resonance (SPR) methods with BIAcore or solution binding assays with competition ELISA or fluorescence quenching with Fab-12 and Y0317 as comparison. "NB" indicates non-binder. "ND" indicates not determined.

FIG. 33A-E shows the inhibition of HM7 tumor growth in nude mice after administration with the G6 antibody, the G6-31 antibody, the Y0317 antibody and the Avastin™ antibody at (A) 0.1 mg/kg dose twice weekly, (B) 0.25 mg/kg dose twice weekly; (C) 0.5 mg/kg dose twice weekly; (D) 2 mg/kg twice weekly and (E) 5 mg/kg dose twice weekly. An anti-ragweed antibody was used as a control.

Figure 34:
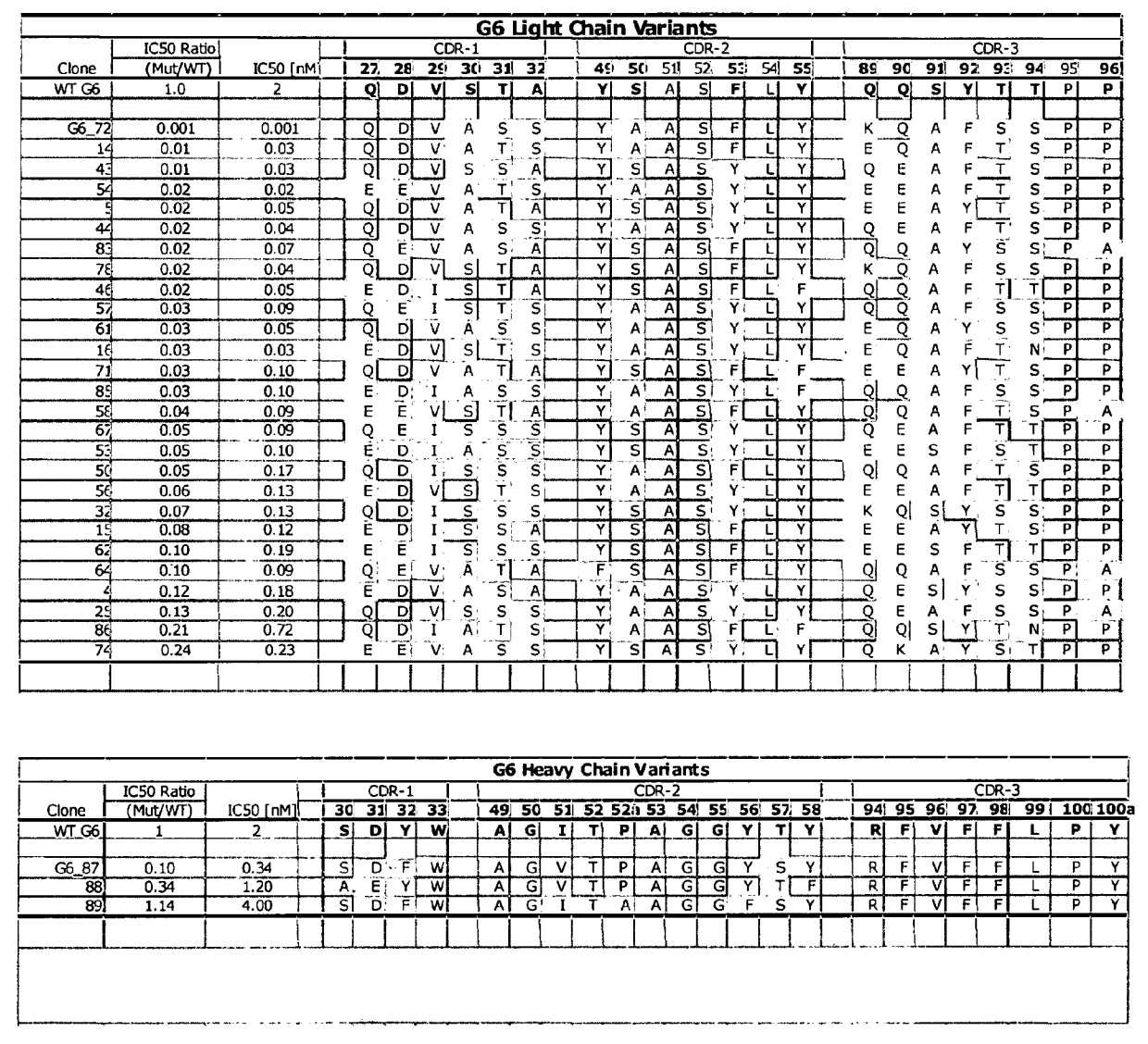

FIG. 34 shows a summary of various G6 (A) light chain and (B) heavy chain variants based on sequence and IC50 analysis (SEQ ID NO. 361-488). The wild type IC50 reflects the mean of the values obtained in the different experiments. Varied amino acid positions are shown in bold. Residues differing from wild type G6 are highlighted. The residues are denoted by the single-letter amino acid code and a number denoting its position according to the scheme of Kabat et al., 1987.

Figure 35:
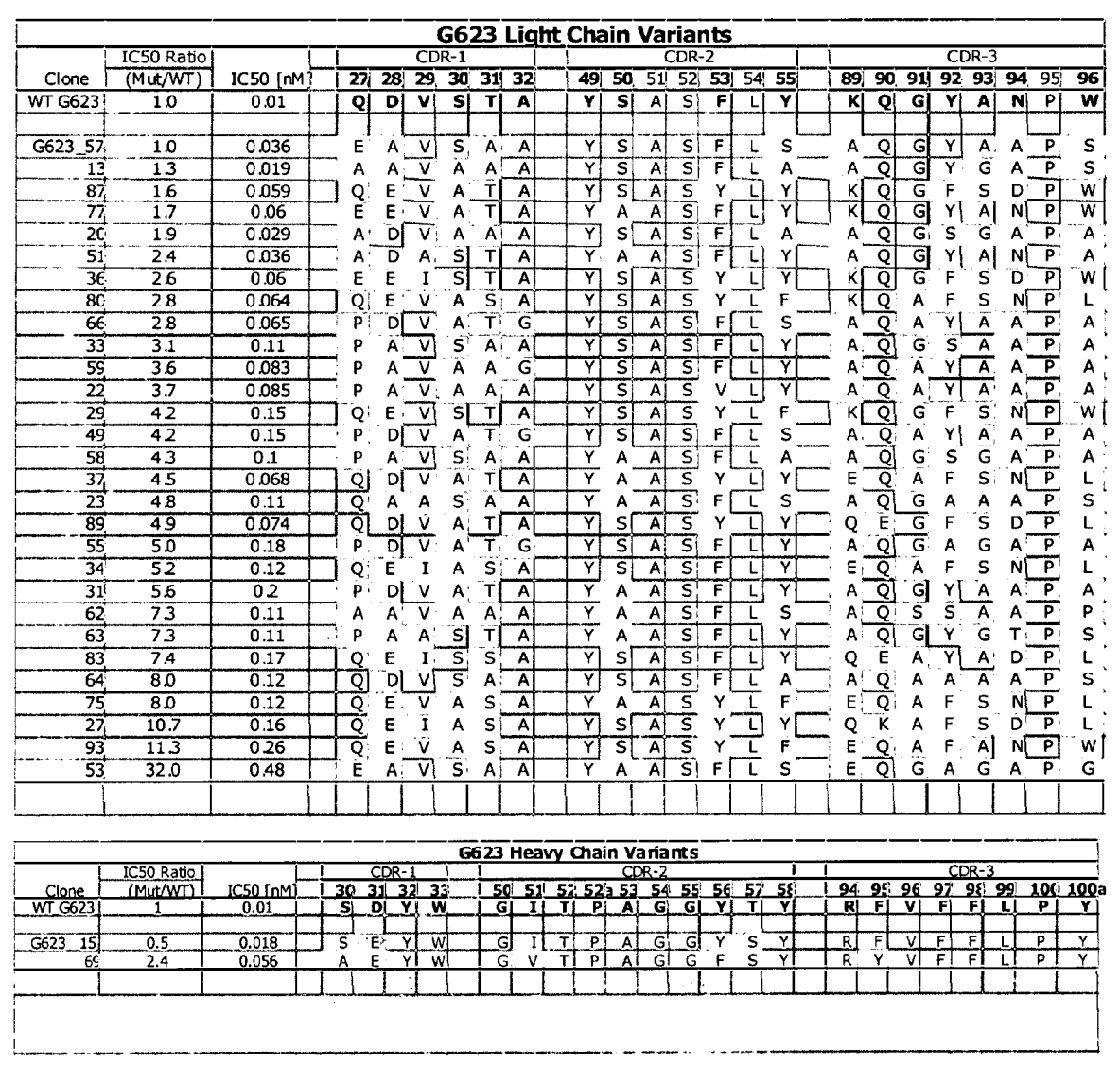

FIG. 35 shows a summary of various G6-23 (A) light chain and (B) heavy chain variants based on sequence and IC50 analysis (SEQ ID NO. 141-272). The wild type IC50 reflects the mean of the values obtained in the different experiments. Varied amino acid positions are shown in bold. Residues differing from wild type G6 are highlighted. The residues are denoted by the single-letter amino acid code and a number denoting its position according to the scheme of Kabat et al., 1987.

Figure 36:
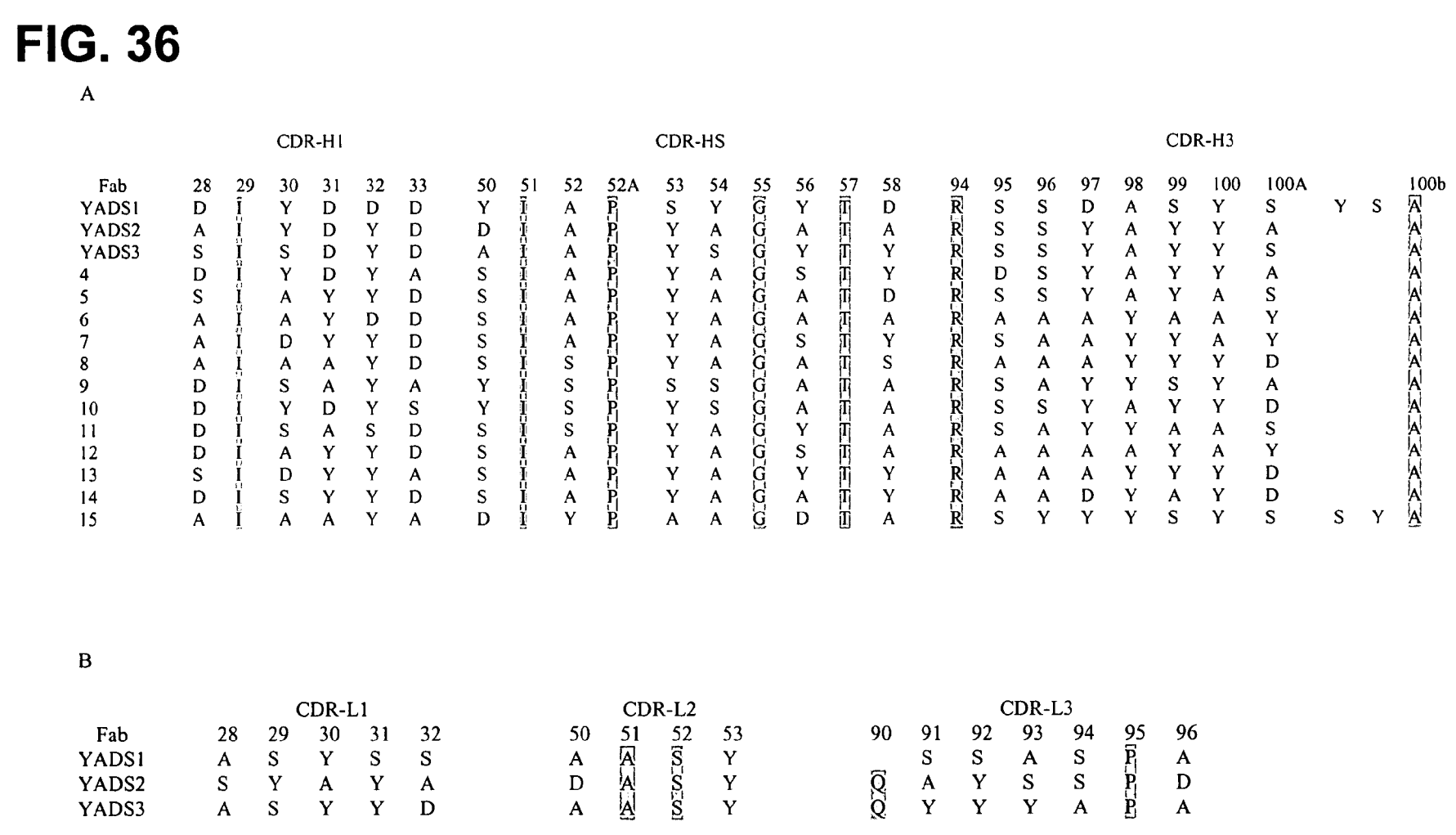

FIG. 36 shows portions of the amino acid sequences of YADS-1, YADS-2 and YADS-3 antibodies and other clones (SEQ ID NO. 489-560). Represented are sequences of three hVEGF binders selected from the YADS-II library. Residues that were not randomized in the library are grey shaded.

FIG. 37 shows amino acid sequences of a group of YADS series antibodies (SEQ ID NO. 273-332). Represented are sequences of unique clones obtained from the sorting of library YADS-A against hVEGF. Residues that were not randomized in the library are grey shaded.

FIG. 38 shows amino acid sequences of a group of YADS series antibodies (SEQ ID NO. 333-360). Represented are sequences of unique clones obtained from the sorting of library YADS-B against hVEGF. Residues that were not randomized in the library are grey shaded.

FIG. 39 shows the Fab sequences of YADS2 and YADS3 antibodies (SEQ ID NO. 19-24). Bolded portions indicate variable region residues. Underlined portions indicate approximate residues of CDR-L1, CDR-L2, CDR-L3, CDR-H1, CDR-H2 or CDR-H3.

FIG. 40 shows NNK variants of the YADS2 antibody (SEQ ID NO. 723-794). "x" indicates a STOP codon or an unreadable sequence.

Figure 41:
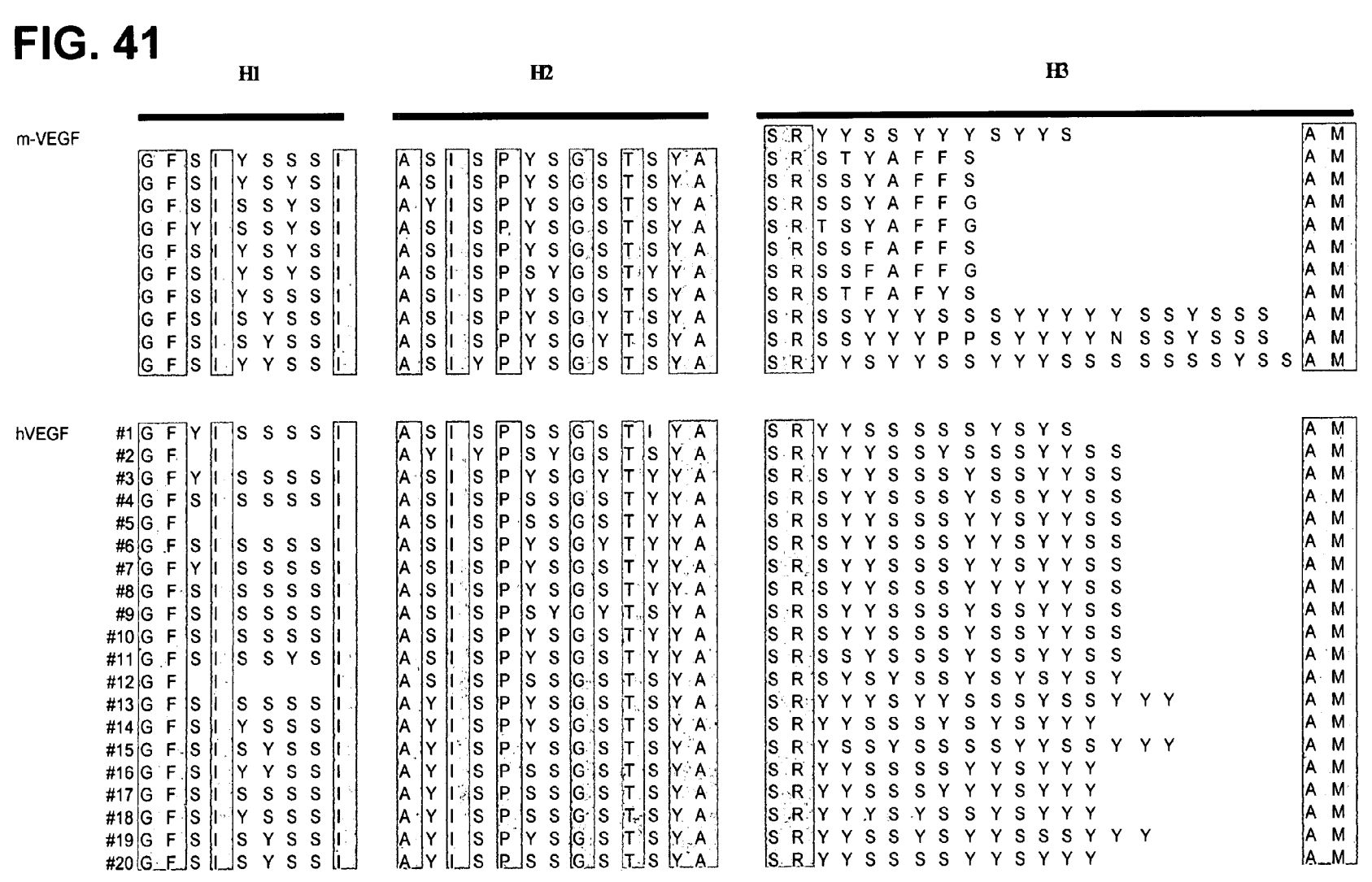

FIG. 41 shows amino acid sequences of a group of YS series antibodies (SEQ ID NO. 795-914). They represent sequences of binders obtained from selection of library YS-A and YS-B.

FIG. 42 shows CDR sequences from anti-VEGF antibodies of the YS libraries (SEQ ID NO. 561-722). Clones 1-52 were selected from library B, while clones 53-63 were selected from library A. From top to bottom, columns 1-5 of CDR-L3 refer to positions 91, 92, 93, 94 and 96, respectively; columns 1-5 of CDR-H1 refer to positions 28, 30, 31, 32, and 33; columns 1-6 of CDR-H2 refer to positions 50, 52, 53, 54, 56 and 58; and columns 1-15 of CDR-H3 refer to positions 95, 96, 97, 98, 99, 100 and 100a-i according to Kabat numbering.

FIG. 43 shows the sequence of the YS1 Fab. Portions in bold indicate residues in the variable region (SEQ ID NO. 42-43).

DETAILED DESCRIPTION OF THE PREFERRED EMBODIMENTS

I. Definitions

The term "antibody" is used in the broadest sense and specifically covers monoclonal antibodies (including full length monoclonal antibodies), polyclonal antibodies, multispecific antibodies (e.g., bispecific antibodies), and antibody fragments so long as they exhibit the desired biological activity. A "G6 series polypeptide" according to this invention is a polypeptide, including an antibody according to this invention, that is derived from a sequence of a G6 antibody or G6-derived antibody according to any one of FIGS. 2, 7, 24-26 and 34-35 and binds to human VEGF with a desired affinity according to this invention (e.g., 10 nm or less, 2 nM or less, 1 mM or less, 0.1 nM or less, 500 pM or less for the Fab version of the antibody at 25° C.). A "B20 series polypeptide" according to this invention is a polypeptide, including an antibody according to this invention, that is derived from a sequence of the B20 antibody or a B20-derived antibody according to any one of FIGS. 27-29 and binds to VEGF with a desired affinity according to this invention. A "YADS series polypeptide" or "YADS polypeptide" according to this invention is a polypeptide, including an antibody according to this invention, that is derived from a sequence of the YADS antibody according to any one of FIGS. 36-40 and binds to VEGF with a desired affinity according to this invention. A "YADS-2 series polypeptide" or "YADS2 polypeptide" according to this invention is a polypeptide, including an antibody according to this invention, that is derived from a sequence of the YADS2 antibody according to FIG. 36 or FIG. 39 and binds to VEGF with a desired affinity according to this invention. A "YADS-3 series polypeptide" or "YADS3 polypeptide" according to this invention is a polypeptide, including an antibody according to this invention, that is derived from a sequence of the YADS3 antibody according to FIG. 36 or FIG. 39 and binds to VEGF with a desired affinity according to this invention. "YS series polypeptide" or "YS polypeptide" according to this invention is a polypeptide, including an antibody according to this invention, that is derived from a sequence of a YS antibody according to FIG. 41-43 and binds to VEGF with a desired affinity according to this invention. According to one preferred embodiment, the G series polypeptide, B20 series polypeptide, the YADS series polypeptide, the YADS2 series polypeptide, the YADS3 series polypeptide or the YS series polypeptide binds to human and a non-human mammalian VEGF with a Kd value that is within 10 fold of each other. According to one embodiment, the kD values for those antibodies binding to human VEGF and a mouse VEGF are 10 nM or less. In another embodiment, the antibodies bind to human VEGF and mouse VEGF with Kd values of 2 nM or less. In another embodiment, the antibodies bind to human VEGF with Kd values of 1 nM or less. The affinities of such G6 series, B20 series, YADS and YS series polypeptides for VEGF can be improved by methods, e.g., such as the phage display techniques taught herein.

As used herein, "antibody variable domain" refers to the portions of the light and heavy chains of antibody molecules that include amino acid sequences of Complementarity Determining Regions (CDRs; ie., CDR1, CDR2, and CDR3), and Framework Regions (FRs). $V_H$ refers to the variable domain of the heavy chain. $V_L$ refers to the variable domain of the light chain. According to the methods used in this invention, the amino acid positions assigned to CDRs and FRs may be defined according to Kabat (Sequences of Proteins of Immunological Interest (National Institutes of Health, Bethesda, Md., 1987 and 1991)). Amino acid numbering of antibodies or antigen binding fragments is also according to that of Kabat.

As used herein, the term "Complementarity Determining Regions (CDRs; ie., CDR1, CDR2, and CDR3) refers to the amino acid residues of an antibody variable domain the presence of which are necessary for antigen binding. Each variable domain typically has three CDR regions identified as CDR1, CDR2 and CDR3. Each complementarity determining region may comprise amino acid residues from a "complementarity determining region" as defined by Kabat (i.e. about residues 24-34 (L1), 50-56 (L2) and 89-97 (L3) in the light chain variable domain and 31-35 (H1), 50-65 (H2) and 95-102 (H3) in the heavy chain variable domain; Kabat et al., *Sequences of Proteins of Immunological Interest,* 5th Ed. Public Health Service, National Institutes of Health, Bethesda, Md. (1991)) and/or those residues from a "hypervariable loop" (i.e. about residues 26-32 (L1), 50-52 (L2) and 91-96 (L3) in the light chain variable domain and 26-32 (H1), 53-55 (H2) and 96-101 (H3) in the heavy chain variable domain; Chothia and Lesk *J. Mol. Biol.* 196:901-917 (1987)). In some instances, a complementarity determining region can include amino acids from both a CDR region defined according to Kabat and a hypervariable loop. For example, the CDRH1 of the heavy chain of antibody 4D5 includes amino acids 26 to 35.

"Framework regions" (hereinafter FR) are those variable domain residues other than the CDR residues. Each variable domain typically has four FRs identified as FR1, FR2, FR3 and FR4. If the CDRs are defined according to Kabat, the light chain FR residues are positioned at about residues 1-23 (LCFR1), 35-49 (LCFR2), 57-88 (LCFR3), and 98-107 (LCFR4) and the heavy chain FR residues are positioned about at residues 1-30 (HCFR1), 36-49 (HCFR2), 66-94 (HCFR3), and 103-113 (HCFR4) in the heavy chain residues. If the CDRs comprise amino acid residues from hypervariable loops, the light chain FR residues are positioned about at residues 1-25 (LCFR1), 33-49 (LCFR2), 53-90 (LCFR3), and 97-107 (LCFR4) in the light chain and the heavy chain FR residues are positioned about at residues 1-25 (HCFR1), 33-52 (HCFR2), 56-95 (HCFR3), and 102-113 (HCFR4) in the heavy chain residues. In some instances, when the CDR comprises amino acids from both a CDR as defined by Kabat and those of a hypervariable loop, the FR residues will be adjusted accordingly. For example, when CDRH1 includes amino acids H26-H35, the heavy chain FR1 residues are at positions 1-25 and the FR2 residues are at positions 36-49.

As used herein, "codon set" refers to a set of different nucleotide triplet sequences used to encode desired variant amino acids. A set of oligonucleotides can be synthesized, for example, by solid phase synthesis, including sequences that represent all possible combinations of nucleotide triplets provided by the codon set and that will encode the desired group of amino acids. A standard form of codon designation is that of the IUB code, which is known in the art and described herein. A codon set typically is represented by 3 capital letters in italics, e.g. NNK, NNS, XYZ, DVK and the like. A "non-random codon set", as used herein, thus refers to a codon set that encodes select amino acids that fulfill partially, preferably completely, the criteria for amino acid selection as described herein. Synthesis of oligonucleotides with selected nucleotide "degeneracy" at certain positions is well known in that art, for example the TRIM approach (Knappek et al.; *J. Mol. Biol.* (1999), 296:57-86); Garrard & Henner, Gene (1993), 128:103). Such sets of oligonucleotides having certain codon sets can be synthesized using commercial nucleic acid synthesizers (available from, for example, Applied Biosystems, Foster City, Calif.), or can be obtained commercially (for example, from Life Technologies, Rockville, Md.). Therefore, a set of oligonucleotides synthesized having a particular codon set will typically include a plurality of oligonucleotides with different sequences, the differences established by the codon set within the overall sequence. Oligonucleotides, as used according to the invention, have sequences that allow for hybridization to a variable domain nucleic acid template and also can, but does not necessarily, include restriction enzyme sites useful for, for example, cloning purposes.

An "Fv" fragment is an antibody fragment which contains a complete antigen recognition and binding site. This region consists of a dimer of one heavy and one light chain variable domain in tight association, which can be covalent in nature, for example in scFv. It is in this configuration that the three CDRs of each variable domain interact to define an antigen binding site on the surface of the $V_H$-$V_L$ dimer. Collectively, the six CDRs or a subset thereof confer antigen binding specificity to the antibody. However, even a single variable domain (or half of an Fv comprising only three CDRs specific for an antigen) has the ability to recognize and bind antigen, although usually at a lower affinity than the entire binding site.

The "Fab" fragment contains a variable and constant domain of the light chain and a variable domain and the first constant domain (CH1) of the heavy chain. F(ab')$_2$ antibody fragments comprise a pair of Fab fragments which are generally covalently linked near their carboxy termini by hinge cysteines between them. Other chemical couplings of antibody fragments are also known in the art.

"Single-chain Fv" or "scFv" antibody fragments comprise the $V_H$ and $V_L$ domains of antibody, wherein these domains are present in a single polypeptide chain. Generally the Fv polypeptide further comprises a polypeptide linker between the $V_H$ and $V_L$ domains, which enables the scFv to form the desired structure for antigen binding. For a review of scFv, see Pluckthun in *The Pharmacology of Monoclonal Antibodies*, Vol 113, Rosenburg and Moore eds. Springer-Verlag, New York, pp. 269-315 (1994).

The term "diabodies" refers to small antibody fragments with two antigen-binding sites, which fragments comprise a heavy chain variable domain ($V_H$) connected to a light chain variable domain ($V_L$) in the same polypeptide chain ($V_H$ and $V_L$). By using a linker that is too short to allow pairing between the two domains on the same chain, the domains are forced to pair with the complementary domains of another chain and create two antigen-binding sites. Diabodies are described more fully in, for example, EP 404,097; WO 93/11161; and Hollinger et al., *Proc. Natl. Acad. Sci. USA*, 90:6444-6448 (1993).

The expression "linear antibodies" refers to the antibodies described in Zapata et al., *Protein Eng.*, 8(10):1057-1062 (1995). Briefly, these antibodies comprise a pair of tandem Fd segments ($V_H$-$C_H$1-$V_H$-$C_H$1) which, together with complementary light chain polypeptides, form a pair of antigen binding regions. Linear antibodies can be bispecific or monospecific.

The term "monoclonal antibody" as used herein refers to an antibody obtained from a population of substantially homogeneous antibodies, i.e., the individual antibodies comprising the population are identical except for possible naturally occurring mutations that may be present in minor amounts. Monoclonal antibodies are highly specific, being directed against a single antigenic site. Furthermore, in contrast to conventional (polyclonal) antibody preparations which typically include different antibodies directed against different determinants (epitopes), each monoclonal antibody is directed against a single determinant on the antigen. The modifier "monoclonal" indicates the character of the antibody as being obtained from a substantially homogeneous population of antibodies, and is not to be construed as requiring production of the antibody by any particular method. For example, the monoclonal antibodies to be used in accordance with the present invention may be made by the hybridoma method first described by Kohler et al., *Nature* 256:495 (1975), or may be made by recombinant DNA methods (see, e.g., U.S. Pat. No. 4,816,567). The "monoclonal antibodies" may also be isolated from phage antibody libraries using the techniques described in Clackson et al., *Nature* 352:624-628 (1991) and Marks et al., *J. Mol. Biol.* 222:581-597 (1991), for example.

The monoclonal antibodies herein specifically include "chimeric" antibodies (immunoglobulins) in which a portion of the heavy and/or light chain is identical with or homologous to corresponding sequences in antibodies derived from a particular species or belonging to a particular antibody class or subclass, while the remainder of the chain(s) is identical with or homologous to corresponding sequences in antibodies derived from another species or belonging to another antibody class or subclass, as well as fragments of such antibodies, so long as they exhibit the desired biological activity (U.S. Pat. No. 4,816,567; and Morrison et al., *Proc. Natl. Acad. Sci. USA* 81:6851-6855 (1984)).

"Humanized" forms of non-human (e.g., murine) antibodies are chimeric antibodies which contain minimal sequence derived from non-human immunoglobulin. For the most part, humanized antibodies are human immunoglobulins (recipient antibody) in which residues from a hypervariable region of the recipient are replaced by residues from a hypervariable region of a non-human species (donor antibody) such as mouse, rat, rabbit or nonhuman primate having the desired specificity, affinity, and capacity. In some instances, Fv framework region (FR) residues of the human immunoglobulin are replaced by corresponding non-human residues. Furthermore, humanized antibodies may comprise residues which are not found in the recipient antibody or in the donor antibody. These modifications are made to further refine antibody performance. In general, the humanized antibody will comprise substantially all of at least one, and typically two, variable domains, in which all or substantially all of the hypervariable loops correspond to those of a non-human immunoglobulin and all or substantially all of the FR regions are those of a human immunoglobulin sequence. The humanized antibody optionally also will comprise at least a portion of an immunoglobulin constant region (Fc), typically that of a human immunoglobulin. For further details, see Jones et al., *Nature* 321:522-525 (1986); Riechmann et al., *Nature* 332:323-329 (1988); and Presta, *Curr. Op. Struct. Biol*, 2:593-596 (1992).

A "species-dependent antibody" is one which has a stronger binding affinity for an antigen from a first mammalian species than it has for a homologue of that antigen from a second mammalian species. Normally, the species-dependent antibody "binds specifically" to a human antigen (i.e. has a binding affinity ($K_d$) value of no more than about $1 \times 10^{-7}$ M, preferably no more than about $1 \times 10^{-8}$ M and most preferably no more than about $1 \times 10^{-9}$ M) but has a binding affinity for a homologue of the antigen from a second nonhuman mammalian species which is at least about 50 fold, or at least about 500 fold, or at least about 1000 fold, weaker than its binding affinity for the human antigen. The species-dependent antibody can be any of the various types of antibodies as defined above, but preferably is a humanized or human antibody.

As used herein, "antibody mutant" or "antibody variant" refers to an amino acid sequence variant of the species-dependent antibody wherein one or more of the amino acid residues of the species-dependent antibody have been modified. Such mutants necessarily have less than 100% sequence identity or similarity with the species-dependent antibody. In a preferred embodiment, the antibody mutant will have an amino acid sequence having at least 75% amino acid sequence identity or similarity with the amino acid sequence of either the heavy or light chain variable domain of the species-dependent antibody, more preferably at least 80%, more preferably at least 85%, more preferably at least 90%, and most preferably at least 95%. Identity or similarity with respect to this sequence is defined herein as the percentage of amino acid residues in the candidate sequence that are identical (i.e same residue) or similar (i.e. amino acid residue from the same group based on common side-chain properties, see below) with the species-dependent antibody residues, after aligning the sequences and introducing gaps, if necessary, to achieve the maximum percent sequence identity. None of N-terminal, C-terminal, or internal extensions, deletions, or insertions into the antibody sequence outside of the variable domain shall be construed as affecting sequence identity or similarity.

To increase the half-life of the antibodies or polypeptide containing the amino acid sequences of this invention, one can attach a salvage receptor binding epitope to the antibody (especially an antibody fragment), as described, e.g., in U.S. Pat. No. 5,739,277. For example, a nucleic acid molecule encoding the salvage receptor binding epitope can be linked in frame to a nucleic acid encoding a polypeptide sequence of this invention so that the fusion protein expressed by the engineered nucleic acid molecule comprises the salvage receptor binding epitope and a polypeptide sequence of this invention. As used herein, the term "salvage receptor binding epitope" refers to an epitope of the Fc region of an IgG molecule (e.g., IgG$_1$, IgG$_2$, IgG$_3$, or IgG$_4$) that is responsible for increasing the in vivo serum half-life of the IgG molecule (e.g., Ghetie, V et al., (2000) *Ann. Rev. Immunol.* 18:739-766, Table 1). Antibodies with substitutions in an Fc region thereof and increased serum half-lives are also described in WO00/42072 (Presta, L.), WO 02/060919; Shields, R. L., et al., (2001) *JBC* 276(9):6591-6604; Hinton, P. R., (2004) *JBC* 279(8):6213-6216). In another embodiment, the serum half-life can also be increased, for example, by attaching other polypeptide sequences. For example, antibodies of this invention or other polypeptide containing the amino acid sequences of this invention can be attached to serum albumin or a portion of serum albumin that binds to the FcRn receptor or a serum albumin binding peptide so that serum albumin binds to the antibody or polypeptide, e.g., such polypeptide sequences are disclosed in WO01/45746. In one preferred embodiment, the serum albumin peptide to be attached comprises an amino acid sequence of DICLPRWGCLW (SEQ ID NO: 935). In another embodiment, the half-life of a Fab according to this invention is increased by these methods. See also, Dennis, M. S., et al., (2002) *JBC* 277(38):35035-35043 for serum albumin binding peptide sequences.

An "isolated" antibody is one which has been identified and separated and/or recovered from a component of its natural environment. Contaminant components of its natural environment are materials which would interfere with diagnostic or therapeutic uses for the antibody, and may include enzymes, hormones, and other proteinaceous or nonproteinaceous solutes. In preferred embodiments, the antibody will be purified (1) to greater than 95% by weight of antibody as determined by the Lowry method, and most preferably more than 99% by weight, (2) to a degree sufficient to obtain at least 15 residues of N-terminal or internal amino acid sequence by use of a spinning cup sequenator, or (3) to homogeneity by SDS-PAGE under reducing or nonreducing conditions using Coomassie blue or, preferably, silver stain. Isolated antibody includes the antibody in situ within recombinant cells since at least one component of the antibody's natural environment will not be present. Ordinarily, however, isolated antibody will be prepared by at least one purification step.

An "angiogenic factor or agent" is a growth factor which stimulates the development of blood vessels, e.g., promote angiogenesis, endothelial cell growth, stability of blood vessels, and/or vasculogenesis, etc. For example, angiogenic factors, include, but are not limited to, e.g., VEGF and members of the VEGF family, PIGF, PDGF family, fibroblast growth factor family (FGFs), TIE ligands (Angiopoietins), ephrins, Del-1, fibroblast growth factors: acidic (aFGF) and basic (bFGF), Follistatin, Granulocyte colony-stimulating factor (G-CSF), Hepatocyte growth factor (HGF)/scatter factor (SF), Interleukin-8 (IL-8), Leptin, Midkine, Placental growth factor, Platelet-derived endothelial cell growth factor (PD-ECGF), Platelet-derived growth factor, especially PDGF-BB or PDGFR-beta, Pleiotrophin (PTN), Progranulin, Proliferin, Transforming growth factor-alpha (TGF-alpha), Transforming growth factor-beta (TGF-beta), Tumor necrosis factor-alpha (TNF-alpha), Vascular endothelial growth factor (VEGF)/vascular permeability factor (VPF), etc. It would also include factors that accelerate wound healing, such as growth hormone, insulin-like growth factor-I (IGF-I), VIGF, epidermal growth factor (EGF), CTGF and members of its family, and TGF-alpha and TGF-beta. See, e.g., Klagsbrun and D'Amore, *Annu. Rev. Physiol.*, 53:217-39 (1991); Streit and Detmar, *Oncogene,* 22:3172-3179 (2003); Ferrara & Alitalo, *Nature Medicine* 5(12):1359-1364 (1999); Tonini et al., *Oncogene,* 22:6549-6556 (2003) (e.g., Table 1 listing known angiogenic factors); and, Sato Int. *J. Clin. Oncol.,* 8:200-206 (2003).

An "anti-angiogenesis agent" or "angiogenesis inhibitor" refers to a small molecular weight substance, an polynucleotide, an polypeptide, an isolated protein, a recombinant protein, an antibody, or conjugates or fusion proteins thereof, that inhibits angiogenesis, vasculogenesis, or undesirable vascular permeability, either directly or indirectly. It should be understood that the anti-angiogenesis agent includes those agents that bind and block the angiogenic activity of the angiogenic factor or its receptor. For example, an anti-angiogenesis agent is an antibody or other antagonist to an angiogenic agent as defined above, e.g., antibodies to VEGF-A or to the VEGF-A receptor (e.g., KDR receptor or Flt-1 receptor), anti-PDGFR inhibitors such as Gleevec™ (Imatinib Mesylate). Anti-angiogensis agents also include native angiogenesis inhibitors, e.g., angiostatin, endostatin, etc. See, e.g., Klagsbrun and D'Amore, *Annu. Rev. Physiol.,* 53:217-39 (1991); Streit and Detmar, *Oncogene,* 22:3172-3179 (2003) (e.g., Table 3 listing anti-angiogenic therapy in malignant melanoma); Ferrara & Alitalo, Nature Medicine 5(12):1359-1364 (1999); Tonini et al., *Oncogene,* 22:6549-6556 (2003) (e.g., Table 2 listing known antiangiogenic factors); and, Sato *Int. J. Clin. Oncol.,* 8:200-206 (2003) (e.g., Table 1 lists anti-angiogenic agents used in clinical trials).

The "Kd" or "Kd value" according to this invention is in one preferred embodiment measured by a radiolabeled VEGF binding assay (RIA) performed with the Fab version of the antibody and a VEGF molecule as described by the following assay that measures solution binding affinity of Fabs for VEGF by equilibrating Fab with a minimal concentration of ($^{125}$I)-labeled VEGF(L109) in the presence of a titration series of unlabeled VEGF, then capturing bound VEGF with an anti-Fab antibody-coated plate (Chen, et al., (1999) *J. Mol Biol* 293:865-881). To establish conditions for the assay, microtiter plates (Dynex) are coated overnight with 5 ug/ml of a capturing anti-Fab antibody (Cappel Labs) in 50 mM sodium carbonate (pH 9.6), and subsequently blocked with 2% (w/v) bovine serum albumin in PBS for two to five hours at room temperature (approximately 23° C.). In a non-adsorbant plate (Nunc #269620), 100 pM or 26 pM [$^{125}$I]VEGF (109) are mixed with serial dilutions of a Fab of interest, e.g., Fab-12 (Presta et al., (1997) *Cancer Res.* 57:4593-4599). The Fab of interest is then incubated overnight; however, the incubation may continue for 65 hours to insure that equilibrium is reached. Thereafter, the mixtures are transferred to the capture plate for incubation at room temperature for one hour. The solution is then removed and the plate washed eight times with 0.1% Tween-20 in PBS. When the plates had dried, 150 ul/well of scintillant (MicroScint-20; Packard) is added, and the plates are counted on a Topcount gamma counter (Packard) for ten minutes. Concentrations of each Fab that give less than or equal to 20% of maximal binding are chosen for use in competitive binding assays. According to another embodiment the Kd or Kd value is measured by using surface plasmon resonance assays using a BIAcore™-2000 or a BIAcore™-3000 (BIAcore, Inc., Piscataway, N.J.) at 25° C. with immobilized hVEGF (8-109) CM5 chips at ~10 response units (RU). Briefly, carboxymethylated dextran biosensor chips (CM5, BIAcore Inc.) are activated with N-ethyl-N'-(3-dimethylaminopropyl)-carbodiimide hydrochloride (EDC) and N-hydroxysuccinimide (NHS) according to the supplier's instructions. Human VEGF is diluted with 10 mM sodium acetate, pH 4.8, into 5 ug/ml (~0.2 uM) before injection at a flow rate of 5 ul/minute to achieve approximately 10 response units (RU) of coupled protein. Following the injection of human VEGF, 1M ethanolamine is injected to block unreacted groups. For kinetics measurements, two-fold serial dilutions of Fab (0.78 nM to 500 nM) are injected in PBS with 0.05% Tween 20 (PBST) at 25° C. at a flow rate of approximately 25 ul/min. Association rates ($k_{on}$) and dissociation rates ($k_{off}$) are calculated using a simple one-to-one Langmuir binding model (BIAcore Evaluation Software version 3.2) by simultaneous fitting the association and dissociation sensorgram. The equilibrium dissociation constant (Kd) was calculated as the ratio $k_{off}/k_{on}$. See, e.g., Chen, Y., et al., (1999) *J. Mol Biol* 293:865-881. If the on-rate exceeds $10^6$ $M^{-1}$ $S^{-1}$ by the surface plasmon resonance assay above, then the on-rate is can be determined by using a fluorescent quenching technique that measures the increase or decrease in fluorescence emission intensity (excitation=295 nm; emission=340 nm, 16 nm band-pass) at 25° C. of a 20 nM anti-VEGF antibody (Fab form) in PBS, pH 7.2, in the presence of increasing concentrations of human VEGF short form (8-109) or mouse VEGF as measured in a spectrometer, such as a stop-flow equipped spectrophometer (Aviv Instruments) or a 8000-series SLM-Aminco spectrophotometer (ThermoSpectronic) with a stirred cuvette.

An "on-rate" or "rate of association" or "association rate" or "$k_{on}$" according to this invention is preferably determined with same surface plasmon resonance technique described above using a BIAcore™-2000 or a BIAcore™-3000 (BIAcore, Inc., Piscataway, N.J.) at 25° C. with immobilized hVEGF (8-109) CM5 chips at ~10 response units (RU). Briefly, carboxymethylated dextran biosensor chips (CM5, BIAcore Inc.) are activated with N-ethyl-N'-(3-dimethylaminopropyl)-carbodiimide hydrochloride (EDC) and N-hydroxysuccinimide (NHS) according to the supplier's instructions. Human VEGF is diluted with 10 mM sodium acetate, pH 4.8, into 5 ug/ml (~0.2uM) before injection at a flow rate of 5 ul/minute to achieve approximately 10 response units (RU) of coupled protein. Following the injection of 1M ethanolamine to block unreacted groups. For kinetics measurements, two-fold serial dilutions of Fab (0.78 nM to 500 nM) are injected in PBS with 0.05% Tween 20 (PBST) at 25° C. at a flow rate of approximately 25 ul/min. Association rates ($k_{on}$) and dissociation rates ($k_{off}$) are calculated using a simple one-to-one Langmuir binding model (BIAcore Evaluation Software version 3.2) by simultaneous fitting the association and dissociation sensorgram. The equilibrium dissociation constant (Kd) was calculated as the ratio $k_{off}/k_{on}$, See, e.g., Chen, Y., et al., (1999) *J. Mol Biol* 293:865-881. However, if the on-rate exceeds $10^6$ $M^{-1}$ $S^{-1}$ by the surface plasmon resonance assay above, then the on-rate is preferably determined by using a fluorescent quenching technique that measures the increase or decrease in fluorescence emission intensity (excitation=295 nm; emission=340 nm, 16 nm band-pass) at 25° C. of a 20 nM anti-VEGF antibody (Fab form) in PBS, pH 7.2, in the presence of increasing concentrations of human short form (8-109) or mouse VEGF as measured in a spectrometer, such as a stop-flow equipped spectrophometer (Aviv Instruments) or a 8000-series SLM-Aminco spectrophotometer (ThermoSpectronic) with a stirred cuvette.

A "functional epitope" according to this invention refers to amino acid residues of an antigen that contribute energetically to the binding of an antibody. Mutation of any one of the energetically contributing residues of the antigen (for example, mutation of wild-type VEGF by alanine or homolog mutation) will disrupt the binding of the antibody such that the relative affinity ratio (IC50mutant VEGF/IC50wild-type VEGF) of the antibody will be greater than 5 (see Example 2). In a preferred embodiment, the relative affinity ratio is determined by a solution binding phage displaying ELISA. Briefly, 96-well Maxisorp immunoplates (NUNC) are coated overnight at 4° C. with an Fab form of the antibody to be tested at a concentration of 2 ug/ml in PBS, and blocked with PBS, 0.5% BSA, and 0.05% Tween20 (PBT) for 2 h at room temperature. Serial dilutions of phage displaying hVEGF alanine point mutants (residues 8-109 form) or wild type hVEGF (8-109) in PBT are first incubated on the Fab-coated plates for 15 min at room temperature, and the plates are washed with PBS, 0.05% Tween20 (PBST). The bound phage is detected with an anti-M13 monoclonal antibody horseradish peroxidase (Amersham Pharmacia) conjugate diluted 1:5000 in PBT, developed with 3,3', 5,5'-tetramethylbenzidine (TMB, Kirkegaard & Perry Labs, Gaithersburg, M D) substrate for approximately 5 min, quenched with 1.0 M $H_3PO_4$, and read spectrophotometrically at 450 nm. The ratio of IC50 values (IC50,ala/IC50,wt) represents the fold of reduction in binding affinity (the relative binding affinity).

For competitive binding assays, Maxisorb plates are coated and blocked as above, and serial threefold dilutions of unlabeled VEGF(109) are made in PBS/Tween buffer in a Nunc plate. [$^{125}$I]VEGF(109) is added, followed by addition of a fixed concentration of the Fab of interest. The final concentrations of the Fab of interest are 100 pM and 10 pM, respectively. After incubation (as above), bound VEGF is captured and quantified as described above. The binding data is analyzed using a computer program to perform Scatchard analysis (P. Munson et al., (1980) *Anal. Biochem.* (1980) 107:220-239) for determination of the dissociation binding constants, $K_d$.

As used herein, "library" refers to a plurality of antibody or antibody fragment sequences (for example, polypeptides of the invention), or the nucleic acids that encode these sequences, the sequences being different in the combination of variant amino acids that are introduced into these sequences according to the methods of the invention.

"Phage display" is a technique by which variant polypeptides are displayed as fusion proteins to at least a portion of coat protein on the surface of phage, e.g., filamentous phage, particles. A utility of phage display lies in the fact that large libraries of randomized protein variants can be rapidly and efficiently sorted for those sequences that bind to a target antigen with high affinity. Display of peptide and protein libraries on phage has been used for screening millions of polypeptides for ones with specific binding properties. Polyvalent phage display methods have been used for displaying small random peptides and small proteins through fusions to either gene III or gene VIII of filamentous phage. Wells and Lowman, *Curr. Opin. Struct. Biol.*, 3:355-362 (1992), and references cited therein. In a monovalent phage display, a protein or peptide library is fused to a gene III or a portion thereof, and expressed at low levels in the presence of wild type gene III protein so that phage particles display one copy or none of the fusion proteins. Avidity effects are reduced relative to polyvalent phage so that sorting is on the basis of intrinsic ligand affinity, and phagemid vectors are used, which simplify DNA manipulations. Lowman and Wells, *Methods: A companion to Methods in Enzymology*, 3:205-0216 (1991).

A "phagemid" is a plasmid vector having a bacterial origin of replication, e.g., Co1E1, and a copy of an intergenic region of a bacteriophage. The phagemid may be used on any known bacteriophage, including filamentous bacteriophage and lambdoid bacteriophage. The plasmid will also generally contain a selectable marker for antibiotic resistance. Segments of DNA cloned into these vectors can be propagated as plasmids. When cells harboring these vectors are provided with all genes necessary for the production of phage particles, the mode of replication of the plasmid changes to rolling circle replication to generate copies of one strand of the plasmid DNA and package phage particles. The phagemid may form infectious or non-infectious phage particles. This term includes phagemids which contain a phage coat protein gene or fragment thereof linked to a heterologous polypeptide gene as a gene fusion such that the heterologous polypeptide is displayed on the surface of the phage particle.

The term "phage vector" means a double stranded replicative form of a bacteriophage containing a heterologous gene and capable of replication. The phage vector has a phage origin of replication allowing phage replication and phage particle formation. The phage is preferably a filamentous bacteriophage, such as an M13, f1, fd, Pf3 phage or a derivative thereof, or a lambdoid phage, such as lambda, 21, phi80, phi81, 82, 424, 434, etc., or a derivative thereof.

As used herein, "solvent accessible position" refers to a position of an amino acid residue in the variable regions of the heavy and light chains of a source antibody or antigen binding fragment that is determined, based on structure, ensemble of structures and/or modeled structure of the antibody or antigen binding fragment, as potentially available for solvent access and/or contact with a molecule, such as an antibody-specific antigen. These positions are typically found in the CDRs and on the exterior of the protein. The solvent accessible positions of an antibody or antigen binding fragment, as defined herein, can be determined using any of a number of algorithms known in the art. Preferably, solvent accessible positions are determined using coordinates from a 3-dimensional model of an antibody, preferably using a computer program such as the InsightII program (Accelrys, San Diego, Calif.). Solvent accessible positions can also be determined using algorithms known in the art (e.g., Lee and Richards, J. Mol. Biol. 55, 379 (1971) and Connolly, J. Appl. Cryst. 16, 548 (1983)). Determination of solvent accessible positions can be performed using software suitable for protein modeling and 3-dimensional structural information obtained from an antibody. Software that can be utilized for these purposes includes SYBYL Biopolymer Module software (Tripos Associates). Generally and preferably, where an algorithm (program) requires a user input size parameter, the "size" of a probe which is used in the calculation is set at about 1.4 Angstrom or smaller in radius. In addition, determination of solvent accessible regions and area methods using software for personal computers has been described by Pacios ((1994) "ARVOMOL/CONTOUR: molecular surface areas and volumes on Personal Computers." *Comput. Chem.* 18(4): 377-386; and (1995). "Variations of Surface Areas and Volumes in Distinct Molecular Surfaces of Biomolecules." *J. Mol. Model.* 1: 46-53.)

"Treatment" refers to both therapeutic treatment and prophylactic or preventative measures. Those in need of treatment include those already with the disorder as well as those in which the disorder is to be prevented.

A "disorder" is any condition that would benefit from treatment with the antibody. For example, mammals who suffer from or need prophylaxis against abnormal angiogenesis (excessive, inappropriate or uncontrolled angiogenesis) or vascular permeability. This includes chronic and acute disorders or diseases including those pathological conditions which predispose the mammal to the disorder in question. Non-limiting examples of disorders to be treated herein include malignant and benign tumors; non-leukemias and lymphoid malignancies; neuronal, glial, astrocytal, hypothalamic and other glandular, macrophagal, epithelial, stromal and blastocoelic disorders; and inflammatory, angiogenic and immunologic disorders.

The term abnormal angiogenesis occurs when new blood vessels either grow excessively, insufficiently or inappropriately (e.g., the location, timing or onset of the angiogenesis being undesired from a medical standpoint) in a diseased state or such that it causes a diseased state. Excessive, inappropriate or uncontrolled angiogenesis occurs when there is new blood vessel growth that contributes to the worsening of the diseased state or causes a diseased state, such as in cancer, especially vascularized solid tumors and metastatic tumors (including colon, lung cancer (especially small-cell lung cancer), or prostate cancer), diseases caused by ocular neovascularisation, especially diabetic blindness, retinopathies, primarily diabetic retinopathy or age-induced macular degeneration and rubeosis; psoriasis, psoriatic arthritis, haemangioblastoma such as haemangioma; inflammatory renal diseases, such as glomerulonephritis, especially mesangioproliferative glomerulonephritis, haemolytic uremic syndrome, diabetic nephropathy or hypertensive neplirosclerosis; various imflammatory diseases, such as arthritis, especially rheumatoid arthritis, inflammatory bowel disease, psorsasis, sarcoidosis, arterial arteriosclerosis and diseases occurring after transplants, endometriosis or chronic asthma and more than 70 other conditions. The new blood vessels can feed the diseased tissues, destroy normal tissues, and in the case of cancer, the new vessels can allow tumor cells to escape into the circulation and lodge in other organs (tumor metastases). Insufficient angiogenesis occurs when there is inadequate blood vessels growth that contributes to the worsening of a diseased state, e.g., in diseases such as coronary artery disease, stroke, and delayed wound healing. Further, ulcers, strokes, and heart attacks can result from the absence of angiogenesis that normally required for natural healing.

The present invention contemplates treating those patients that are at risk of developing the above-mentioned illnesses.

Other patients that are candidates for receiving the antibodies or polypeptides of this invention have, or are at risk for developing, abnormal proliferation of fibrovascular tissue, acne rosacea, acquired immune deficiency syndrome, artery occlusion, atopic keratitis, bacterial ulcers, Bechets disease, blood bone tumors, carotid obstructive disease, choroidal neovascularization, chronic inflammation, chronic retinal detachment, chronic uveitis, chronic vitritis, contact lens overwear, corneal graft rejection, corneal neovascularization, corneal graft neovascularization, Crohn's disease, Eales disease, epidemic keratoconjunctivitis, fungal ulcers, Herpes simplex infections, Herpes zoster infections, hyperviscosity syndromes, Kaposi's sarcoma, leukemia, lipid degeneration, Lyme's disease, marginal keratolysis, Mooren ulcer, Mycobacteria infections other than leprosy, myopia, ocular neovascular disease, optic pits, Osler-Weber syndrome (Osler-Weber-Rendu, osteoarthritis, Pagets disease, pars planitis, pemphigoid, phylectenulosis, polyarteritis, post-laser complications, protozoan infections, pseudoxanthoma elasticum, pterygium keratitis sicca, radial keratotomy, retinal neovascularization, retinopathy of prematurity, retrolental fibroplasias, sarcoid, scleritis, sickle cell anemia, Sogrens syndrome, solid tumors, Stargarts disease, Steven's Johnson disease, superior limbic keratitis, syphilis, systemic lupus, Terrien's marginal degeneration, toxoplasmosis, trauma, tumors of Ewing sarcoma, tumors of neuroblastoma, tumors of osteosarcoma, tumors of retinoblastoma, tumors of rhabdomyosarcoma, ulcerative colitis, vein occlusion, Vitamin A deficiency and Wegeners sarcoidosis, undesired angiogenesis associated with diabetes, parasitic diseases, abnormal wound healing, hypertrophy following surgery, injury or trauma, inhibition of hair growth, inhibition of ovulation and corpus luteum formation, inhibition of implantation and inhibition of embryo development in the uterus.

Anti-angiogenesis therapies are useful in the general treatment of graft rejection, lung inflammation, nephrotic syndrome, preeclampsia, pericardial effusion, such as that associated with pericarditis, and pleural effusion, diseases and disorders characterized by undesirable vascular permeability, e.g., edema associated with brain tumors, ascites associated with malignancies, Meigs' syndrome, lung inflammation, nephrotic syndrome, pericardial effusion, pleural effusion, permeability associated with cardiovascular diseases such as the condition following myocardial infarctions and strokes and the like.

Other angiogenesis-dependent diseases according to this invention include angiofibroma (abnormal blood of vessels which are prone to bleeding), neovascular glaucoma (growth of blood vessels in the eye), arteriovenous malformations (abnormal communication between arteries and veins), nonunion fractures (fractures that will not heal), atherosclerotic plaques (hardening of the arteries), pyogenic granuloma (common skin lesion composed of blood vessels), scleroderma (a form of connective tissue disease), hemangioma (tumor composed of blood vessels), trachoma (leading cause of blindness in the third world), hemophilic joints, vascular adhesions and hypertrophic scars (abnormal scar formation).

The term "VEGF" or "VEGF" as used herein refers to the 165-amino acid human vascular endothelial cell growth factor and related 121-, 189-, and 206-amino acid human vascular endothelial cell growth factors, as described by Leung et al. *Science,* 246:1306 (1989), and Houck et al. *Mol. Endocrin.,* 5:1806 (1991), together with the naturally occurring allelic and processed forms thereof. The term "VEGF" also refers to VEGFs from non-human species such as mouse, rat or primate. Sometimes the VEGF from a specific species are indicated by terms such as hVEGF for human VEGF, mVEGF for murine VEGF, and etc. The term "VEGF" is also used to refer to truncated forms of the polypeptide comprising amino acids 8 to 109 or 1 to 109 of the 165-amino acid human vascular endothelial cell growth factor. Reference to any such forms of VEGF may be identified in the present application, e.g., by "VEGF (8-109)," "VEGF (1-109)" or "VEGF$_{165}$." The amino acid positions for a "truncated" native VEGF are numbered as indicated in the native VEGF sequence. For example, amino acid position 17 (methionine) in truncated native VEGF is also position 17 (methionine) in native VEGF. The truncated native VEGF has binding affinity for the KDR and Flt-1 receptors comparable to native VEGF.

The term "VEGF variant" as used herein refers to a VEGF polypeptide which includes one or more amino acid mutations in the native VEGF sequence. Optionally, the one or more amino acid mutations include amino acid substitution(s). For purposes of shorthand designation of VEGF variants described herein, it is noted that numbers refer to the amino acid residue position along the amino acid sequence of the putative native VEGF (provided in Leung et al., supra and Houck et al., supra.).

The terms "cancer" and "cancerous" refer to or describe the physiological condition in mammals that is typically characterized by unregulated cell growth. Examples of cancer include but are not limited to, carcinoma, lymphoma, blastoma, sarcoma, and leukemia. More particular examples of such cancers include squamous cell cancer, small-cell lung cancer, non-small cell lung cancer, gastrointestinal cancer, pancreatic cancer, glioblastoma, cervical cancer, ovarian cancer, liver cancer, bladder cancer, hepatoma, breast cancer, colon cancer, colorectal cancer, endometrial carcinoma, salivary gland carcinoma, kidney cancer, renal cancer, prostate cancer, vulval cancer, thyroid cancer, hepatic carcinoma and various types of head and neck cancer. "Mammal" for purposes of treatment refers to any animal classified as a mammal, including humans, domestic and farm animals, nonhuman primates, and zoo, sports, or pet animals, such as dogs, horses, cats, cows, etc.

The term "anti-neoplastic composition" refers to a composition useful in treating cancer comprising at least one active therapeutic agent, e.g., "anti-cancer agent." Examples of therapeutic agents (anti-cancer agents) include, but are limited to, e.g., chemotherapeutic agents, growth inhibitory agents, cytotoxic agents, agents used in radiation therapy, anti-angiogenesis agents, apoptotic agents, anti-tubulin agents, and other-agents to treat cancer, such as anti-HER-2 antibodies, anti-CD20 antibodies, an epidermal growth factor receptor (EGFR) antagonist (e.g., a tyrosine kinase inhibitor), HER1/EGFR inhibitor (e.g., erlotinib (Tarceva™), platelet derived growth factor inhibitors (e.g., Gleevec™ (Imatinib Mesylate)), a COX-2 inhibitor (e.g., celecoxib), interferons, cytokines, antagonists (e.g., neutralizing antibodies) that bind to one or more of the following targets ErbB2, ErbB3, ErbB4, PDGFR-beta, BlyS, APRIL, BCMA or VEGF receptor(s), TRAIL/Apo2, and other bioactive and organic chemical agents, etc. Combinations thereof are also included in the invention.

The term "epitope tagged" when used herein refers to an antibody mutant fused to an "epitope tag". The epitope tag polypeptide has enough residues to provide an epitope against which an antibody thereagainst can be made, yet is short enough such that it does not interfere with activity of the antibody mutant. The epitope tag preferably also is fairly unique so that the antibody thereagainst does not substantially cross-react with other epitopes. Suitable tag polypeptide generally have at least 6 amino acid residues and usually between about 8-50 amino acid residues (preferably between about 9-30 residues). Examples include the flu HA tag polypeptide and its antibody 12CA5 (Field et al. *Mol. Cell. Biol.* 8:2159-2165 (1988)); the c-myc tag and the 8F9, 3C7, 6E10, G4, B7 and 9E10 antibodies thereagainst (Evan et al., *Mol. Cell. Biol.* 5(12):3610-3616 (1985)); and the Herpes Simplex virus glycoprotein D (gD) tag and its antibody (Paborsky et al., *Protein Engineering* 3(6):547-553 (1990)). In certain embodiments, the epitope tag is a "salvage receptor binding epitope".

The term "cytotoxic agent" as used herein refers to a substance that inhibits or prevents the function of cells and/or causes destruction of cells. The term is intended to include radioactive isotopes (e.g., $I^{131}$, $I^{125}$, $Y^{90}$ and $Re^{186}$), chemotherapeutic agents, and toxins such as enzymatically active toxins of bacterial, fungal, plant or animal origin, or fragments thereof.

A "chemotherapeutic agent" is a chemical compound useful in the treatment of cancer. Examples of chemotherapeutic agents include is a chemical compound useful in the treatment of cancer. Examples of chemotherapeutic agents include alkylating agents such as thiotepa and CYTOXAN® cyclosphosphamide; alkyl sulfonates such as busulfan, improsulfan and piposulfan; aziridines such as benzodopa, carboquone, meturedopa, and uredopa; ethylenimines and methylamelamines including altretamine, triethylenemelamine, trietylenephosphoramide, triethiylenethiophosphoramide and trimethylolomelamine; acetogenins (especially bullatacin and bullatacinone); a camptothecin (including the synthetic analogue topotecan); bryostatin; callystatin; CC-1065 (including its adozelesin, carzelesin and bizelesin synthetic analogues); cryptophycins (particularly cryptophycin 1 and cryptophycin 8); dolastatin; duocarmycin (including the synthetic analogues, KW-2189 and CB1-TM1); eleutherobin; pancratistatin: a sarcodictyin; spongistatin; nitrogen mustards such as chlorambucil, chlomaphazine, cholophosphamide, estramustine, ifosfamide, mechlorethamine, mechlorethamine oxide hydrochloride, melphalan, novembichin, phenesterine, prednimustine, trofosfamide, uracil mustard; nitrosureas such as carmustine, chlorozotocin, fotemustine, lomustine, nimustine, and raninmustine; antibiotics such as the enediyne antibiotics (e.g., calicheamicin, especially calicheamicin gamma II and calicheamicin omegall (see, e.g., Agnew, *Chem Intl. Ed. Engl.,* 33: 183-186 (1994)); dynemicin, including dynemicin A; bisphosphonates, such as clodronate; an esperamicin; as well as neocarzinostatin chromophore and related chromoprotein enediyne antiobiotic chromophores), aclacinomysins, actinomycin, authramycin, azaserine, bleomycins, cactinomycin, carabicin, canninomycin, carzinophilin, chromomycinis, dactinomycin, daunorubicin, detorubicin, 6-diazo-5-oxo-L-norleucine, ADRIAMYCIN® doxorubicin (including morpholino-doxorubicin, cyanomorpholino-doxorubicin, 2-pyrrolino-doxorubicin and deoxydoxorubicin), epirubicin, esorubicin, idarubicin, marcellomycin, mitomycins such as mitomycin C, mycophenolic acid, nogalamycin, olivomycins, peplomycin, potfiromycin, puromycin, quelamycin, rodorubicin, streptonigrin, streptozocin, tubercidin, ubenimex, zinostatin, zorubicin; anti-metabolites such as methotrexate and 5-fluorouracil (5-FU); folic acid analogues such as denopterin, methotrexate, pteropterin, trimetrexate; purine analogs such as fludarabine, 6-mercaptopurine, thiamiprine, thioguanine; pyrimidine analogs such as ancitabine, azacitidine, 6-azauridine, carmofur, cytarabine, dideoxyuridine, doxifluridine, enocitabine, floxuridine; androgens such as calusterone, dromostanolone propionate, epitiostanol, mepitiostane, testolactone; anti-adrenals such as aminoglutethimide, mitotane, trilostane; folic acid replenisher such as frolinic acid; aceglatone; aldophosphamide glycoside; aminolevulinic acid; eniluracil; amsacrine; bestrabucil; bisantrene; edatraxate; defofamine; demecolcine; diaziquone; elfornithine; elliptinium acetate; an epothilone; etoglucid; gallium nitrate; hydroxyurea; lentinan; lonidainine; maytansinoids such as maytansine and ansamitocins; mitoguazone; mitoxantrone; mopidanmol; nitraerine; pentostatin; phenamet; pirarubicin; losoxantrone; podophyllinic acid; 2-ethylhydrazide; procarbazine; PSK® polysaccharide complex (JHS Natural Products, Eugene, Oreg.); razoxane; rhizoxin; sizofiran; spirogermanium; tenuazonic acid; triaziquone; 2,2',2"-trichlorotriethylamine; trichothecenes (especially T-2 toxin, verracurin A, roridin A and anguidine); urethan; vindesine; dacarbazine; mannomustine; mitobronitol; mitolactol; pipobroman; gacytosine; arabinoside ("Ara-C"); cyclophosphamide; thiotepa; taxoids, e.g., TAXOL® paclitaxel (Bristol-Myers Squibb Oncology, Princeton, N.J.), ABRAXANE™ Cremophor-free, albumin-engineered nanoparticle formulation of paclitaxel (American Pharmaceutical Partners, Schaumberg, Ill.), and TAXOTERE® doxetaxel (Rhône-Poulenc Rorer, Antony, France); chloranbucil; GEMZAR® gemcitabine; 6-thioguanine; mercaptopurine; methotrexate; platinum analogs such as cisplatin and carboplatin; vinblastine; platinum; etoposide (VP-16); ifosfamide; mitoxantrone; vincristine; NAVELBINE® vinorelbine; novantrone; teniposide; edatrexate; daunomycin; aminopterin; xeloda; ibandronate; irinotecan (Camptosar, CPT-11) (including the treatment regimen of irinotecan with 5-FU and leucovorin); topoisomerase inhibitor RFS 2000; difluorometlhylornithine (DMFO); retinoids such as retinoic acid; capecitabine; combretastatin; leucovorin (LV); oxaliplatin, including the oxaliplatin treatment regimen (FOLFOX); inhibitors of PKC-alpha, Raf, H-Ras, EGFR (e.g., erlotinib (Tarceva™)) and VEGF-A that reduce cell proliferation and pharmaceutically acceptable salts, acids or derivatives of any of the above.

Also included in this definition are anti-hormonal agents that act to regulate or inhibit hormone action on tumors such as anti-estrogens and selective estrogen receptor modulators (SERMs), including, for example, tamoxifen (including NOLVADEX® tamoxifen), raloxifene, droloxifene, 4-hydroxytamoxifen, trioxifene, keoxifene, LY117018, onapristone, and FARESTON toremifene; aromatase inhibitors that inhibit the enzyme aromatase, which regulates estrogen production in the adrenal glands, such as, for example, 4(5)-imidazoles, aminoglutethimide, MEGASE® megestrol acetate, AROMASIN®V exemestane, formestanie, fadrozole, RIVISOR® vorozole, FEMARA® letrozole, and ARIMIDEX®D anastrozole; and anti-androgens such as flutamide, nilutamide, bicalutamide, leuprolide, and goserelin; as well as troxacitabine (a 1,3-dioxolane nucleoside cytosine analog); antisense oligonucleotides, particularly those which inhibit expression of genes in signaling pathways implicated in abherant cell proliferation, such as, for example, PKC-alpha, Raf and H-Ras; ribozymes such as a VEGF expression inhibitor (e.g., ANGIOZYME® ribozyme) and a HER2 expression inhibitor; vaccines such as gene therapy vaccines, for example, ALLOVECTIN® vaccine, LEUVECTIN® vaccine, and VAXID® vaccine; PROLEUKIN® rIL-2; LURTOTECAN® topoisomerase 1 inhibitor; ABARELX® rmRH; Vinorelbine and Esperamicins (see U.S. Pat. No. 4,675,187), and pharmaceutically acceptable salts, acids or derivatives of any of the above.

The term "prodrug" as used in this application refers to a precursor or derivative form of a pharmaceutically active substance that is less cytotoxic to tumor cells compared to the parent drug and is capable of being enzymatically activated or converted into the more active parent form. See, e.g., Wilman, "Prodrugs in Cancer Chemotherapy" *Biochemical Society Transactions,* 14, pp. 375-382, 615th Meeting Belfast (1986) and Stella et al., "Prodrugs: A Chemical Approach to Targeted Drug Delivery," *Directed Drug Delivery,* Borchardt et al., (ed.), pp. 247-267, Humana Press (1985). The prodrugs of this invention include, but are not limited to, phosphate-containing prodrugs, thiophosphate-containing prodrugs, sulfate-containing prodrugs, peptide-containing prodrugs, D-amino acid-modified prodrugs, glycosylated prodrugs, β-lactam-containing prodrugs, optionally substituted phenoxyacetamide-containing prodrugs or optionally substituted phenylacetamide-containing prodrugs, 5-fluorocytosine and other 5-fluorouridine prodrugs which can be converted into the more active cytotoxic free drug. Examples of cytotoxic drugs that can be derivatized into a prodrug form for use in this invention include, but are not limited to, those chemotherapeutic agents described above.

For the treatment of rheumatoid arthritis, the patient can be treated with an antibody of the invention in conjunction with any one or more of the following drugs: DMARDS (disease-modifying anti-rheumatic drugs (e.g., methotrexate), NSAI or NSAID (non-steroidal anti-inflammatory drugs), HUMIRA™ (adalimumab; Abbott Laboratories), ARAVA® (leflunomide), REMICADE® (infliximab; Centocor Inc., of Malvern, Pa.), ENBREL™ (etanercept; Immunex, Wash.), COX-2 inhibitors. DMARDs commonly used in RA are hydroxycloroquine, sulfasalazine, methotrexate, leflunomide, etanercept, infliximab, azathioprine, D-penicillamine, Gold (oral), Gold (intramuscular), minocycline, cyclosporine, Staphylococcal protein A immunoadsorption. Adalimumab is a human monoclonal antibody that binds to TNFα. Infliximab is a chimeric monoclonal antibody that binds to TNFα. Etanercept is an "immunoadhesin" fusion protein consisting of the extracellular ligand binding portion of the human 75 kD (p75) tumor necrosis factor receptor (TNFR) linked to the Fc portion of a human IgG1. For conventional treatment of RA, see, e.g., "Guidelines for the management of rheumatoid arthritis" *Arthritis & Rheumatism* 46(2): 328-346 (February, 2002). In a specific embodiment, the RA patient is treated with a CD20 antibody of the invention in conjunction with methotrexate (MTX). An exemplary dosage of MTX is about 7.5-25 mg/kg/wk. MTX can be administered orally and subcutaneously.

For the treatment of ankylosing spondylitis, psoriatic arthritis and Crohn's disease, the patient can be treated with an antibody of the invention in conjunction with, for example, Remicade® (infliximab; from Centocor Inc., of Malvern, Pa.), ENBREL (etanercept; Immunex, Wash.).

For treatments for SLE, the patient can be treated with an antibody of the invention in conjunction with, for example, a high-dose corticosteroids and/or cyclophosphamide (HDCC).

For the treatment of psoriasis, patients can be administered an antibody of this invention in conjunction with topical treatments, such as topical steroids, anthralin, calcipotriene, clobetasol, and tazarotene, or with methotrexate, retinoids, cyclosporine, PUVA and UVB therapies. In one embodiment, the psoriasis patient is treated with the antibody sequentially or concurrently with cyclosporine.

An "isolated" nucleic acid molecule is a nucleic acid molecule that is identified and separated from at least one contaminant nucleic acid molecule with which it is ordinarily associated in the natural source of the antibody nucleic acid. An isolated nucleic acid molecule is other than in the form or setting in which it is found in nature. Isolated nucleic acid molecules therefore are distinguished from the nucleic acid molecule as it exists in natural cells. However, an isolated nucleic acid molecule includes a nucleic acid molecule contained in cells that ordinarily express the antibody where, for example, the nucleic acid molecule is in a chromosomal location different from that of natural cells.

The expression "control sequences" refers to DNA sequences necessary for the expression of an operably linked coding sequence in a particular host organism. The control sequences that are suitable for prokaryotes, for example, include a promoter, optionally an operator sequence, and a ribosome binding site. Eukaryotic cells are known to utilize promoters, polyadenylation signals, and enhancers.

Nucleic acid is "operably linked" when it is placed into a functional relationship with another nucleic acid sequence. For example, DNA for a presequence or secretory leader is operably linked to DNA for a polypeptide if it is expressed as a preprotein that participates in the secretion of the polypeptide; a promoter or enhancer is operably linked to a coding sequence if it affects the transcription of the sequence; or a ribosome binding site is operably linked to a coding sequence if it is positioned so as to facilitate translation. Generally, "operably linked" means that the DNA sequences being linked are contiguous, and, in the case of a secretory leader, contiguous and in reading phase. However, enhancers do not have to be contiguous. Linking is accomplished by ligation at convenient restriction sites. If such sites do not exist, the synthetic oligonucleotide adaptors or linkers are used in accordance with conventional practice.

As used herein, the expressions "cell," "cell line," and "cell culture" are used interchangeably and all such designations include progeny. Thus, the words "transformants" and "transformed cells" include the primary subject cell and cultures derived therefrom without regard for the number of transfers. It is also understood that all progeny may not be precisely identical in DNA content, due to deliberate or inadvertent mutations. Mutant progeny that have the same function or biological activity as screened for in the originally transformed cell are included. Where distinct designations are intended, it will be clear from the context.

II. Modes for Carrying out the Invention

Synthetic High-Affinity Anti-VEGF Antibodies

The invention herein provides novel anti-VEGF antibodies with high binding affinity to VEGF. Exemplary methods for generating antibodies are described in more detail in the following sections.

The novel anti-VEGF antibodies are selected using the VEGF antigen derived from a first mammalian species. Preferably the antigen is human VEGF (hVEGF). However, VEGFs from other species such as murine VEGF (mVEGF) can also be used as the first target antigen. The VEGF antigens from various mammalian species may be isolated from natural sources. In other embodiments, the antigen is produced recombinantly or made using other synthetic methods known in the art.

The antibody selected will normally have a sufficiently strong binding affinity for the first VEGF antigen. For example, the antibody may bind hVEGF with a $K_d$ value of no more than about 5 nM, preferably no more than about 2 nM, and more preferably no more than about 500 pM. Antibody affinities may be determined by a surface plasmon resonance based assay (such as the BIAcore assay as described in Examples); enzyme-linked immunoabsorbent assay (ELISA); and competition assays (e.g. RIA's), for example.

Also, the antibody may be subjected to other biological activity assays, e.g., in order to evaluate its effectiveness as a therapeutic. Such assays are known in the art and depend on the target antigen and intended use for the antibody. Examples include the HUVEC inhibition assay (as described in the Examples below); tumor cell growth inhibition assays (as described in WO 89/06692, for example); antibody-dependent cellular cytotoxicity (ADCC) and complement-mediated cytotoxicity (CDC) assays (U.S. Pat. No. 5,500,362); and agonistic activity or hematopoiesis assays (see WO 95/27062).

To screen for antibodies which bind to a particular epitope on the antigen of interest, a routine cross-blocking assay such as that described in *Antibodies, A Laboratory Manual*, Cold Spring Harbor Laboratory, Ed Harlow and David Lane (1988), can be performed. Alternatively, epitope mapping, e.g. as described in Champe et al., *J. Biol. Chem.* 270:1388-1394 (1995), can be performed to determine whether the antibody binds an epitope of interest.

Species-specificity of the novel antibodies is then determined. The binding affinity of the antibody for a homologue of the antigen used to select the antibody (where the homologue is from the "second mammalian species") is assessed using techniques such as those described above. In preferred embodiments, the second mammalian species is a nonhuman mammal to which the antibody will be administered in preclinical studies. Accordingly, the second mammalian species may be a nonhuman primate, such as rhesus, cynomolgus, baboon, chimpanzee and macaque. In other embodiment, the second mammalian species may be a rodent (e.g., mouse or rat), cat or dog, for example.

While the preferred method of the instant invention for determining species-dependence (and for evaluating antibody mutants with improved properties; see below) is to quantify antibody binding affinity, in other embodiments of the invention, one or more biological properties of the synthetic antibody and antibody variants are evaluated in addition to, or instead of, binding affinity determinations. Exemplary such biological assays are described above. Such assays are particularly useful where they provide an indication as to the therapeutic effectiveness of the antibody. Normally, though not necessarily, antibodies which show improved properties in such assays, will also have an enhanced binding affinity. Thus, in one embodiment of the invention where the assay of choice is a biological activity assay other than an binding affinity assay, the species-dependent antibody will normally have a "biological activity" using "material" (e.g. antigen, cell, tissue, organ or whole animal) from the second mammalian species which is at least about 50 fold, or at least about 500 fold, or at least about 1000 fold, less effective than its biological activity in a corresponding assay using reagents from the first mammalian species.

The species-dependent antibody is then altered so as to generate an antibody mutant which has a stronger binding affinity for the antigen from the second mammalian species, than the species-dependent antibody. The antibody mutant preferably has a binding affinity for the antigen from the nonhuman mammal which is at least about 10 fold stronger, preferably at least about 20 fold stronger, more preferably at least about 50 fold stronger, and sometimes at least about 100 fold or 200 fold stronger, than the binding affinity of the species-dependent antibody for the antigen. The enhancement in binding affinity desired or required will depend on the initial binding affinity of the species-dependent antibody. Where the assay used is a biological activity assay, the antibody mutant preferably has a biological activity in the assay of choice which is at least about 10 fold better, preferably at least about 20 fold better, more preferably at least about 50 fold better, and sometimes at least about 100 fold or 200 fold better, than the biological activity of the species-dependent antibody in that assay.

To generate the antibody mutant, one or more amino acid alterations (e.g. substitutions) are introduced in one or more of the hypervariable regions of the species-dependent antibody. Alternatively, or in addition, one or more alterations (e.g. substitutions) of framework region residues may be introduced in the species-dependent antibody where these result in an improvement in the binding affinity of the antibody mutant for the antigen from the second mammalian species. Examples of framework region residues to modify include those which non-covalently bind antigen directly (Amit et al. *Science* 233:747-753 (1986)); interact with/effect the conformation of a CDR (Chothia et al. *J. Mol. Biol.* 196:901-917 (1987)); and/or participate in the $V_L$-$V_H$ interface (EP 239 400B1). In certain embodiments, modification of one or more of such framework region residues results in an enhancement of the binding affinity of the antibody for the antigen from the second mammalian species. For example, from about one to about five framework residues may be altered in this embodiment of the invention. Sometimes, this may be sufficient to yield an antibody mutant suitable for use in preclinical trials, even where none of the hypervariable region residues have been altered. Normally, however, the antibody mutant will comprise additional hypervariable region alteration(s).

The hypervariable region residues which are altered may be changed randomly, especially where the starting binding affinity of the species-dependent antibody for the antigen from the second mammalian species is such that such randomly produced antibody mutants can be readily screened.

One useful procedure for generating such antibody mutants is called "alanine scanning mutagenesis" (Cunningham and Wells *Science* 244:1081-1085 (1989)). Here, one or more of the hypervariable region residue(s) are replaced by alanine or polyalanine residue(s) to affect the interaction of the amino acids with the antigen from the second mammalian species. Those hypervariable region residue(s) demonstrating functional sensitivity to the substitutions then are refined by introducing further or other mutations at or for the sites of substitution. Thus, while the site for introducing an amino acid sequence variation is predetermined, the nature of the mutation per se need not be predetermined. The ala-mutants produced this way are screened for their biological activity as described herein.

Another procedure for generating such antibody mutants involves affinity maturation using phage display (Hawkins et al. *J. Mol. Biol.* 254:889-896 (1992) and Lowman et al. *Biochemistry* 30(45):10832-10837 (1991)). Briefly, several hypervariable region sites (e.g. 6-7 sites) are mutated to generate all possible amino substitutions at each site. The antibody mutants thus generated are displayed in a monovalent fashion from filamentous phage particles as fusions to the gene III product of M13 packaged within each particle. The phage-displayed mutants are then screened for their biological activity (e.g. binding affinity) as herein disclosed.

The invention also provides a more systematic method for identifying amino acid residues to modify. According to this method, one identifies hypervariable region residues in the species-dependent antibody which are involved in binding the antigen from the first mammalian species and those hypervariable region residues involved in binding a homologue of that antigen from the second mammalian species. To achieve this, an alanine-scan of the hypervariable region residues of the species-dependent antibody can be performed, with each ala-mutant being testing for binding to the antigen from the first and second mammalian species. Alternatively, the X-ray crystal structures of antibody-antigen complexes are analyzed for contacting residues as well as surrounding residues (as described in Examples). The hypervariable region residues involved in binding the antigen from the first mammalian species (e.g. human), and those involved in binding the homologue of the antigen from the second mammalian species (e.g. nonhuman mammal) are thereby identified. Preferably, those residue(s) significantly involved in binding the antigen from the second mammalian species (e.g. nonhuman mammal), but not the antigen from the first mammalian species (e.g. human), are chosen as candidates for modification. In another embodiment, those residue(s) significantly involved in binding the antigen from both the first and second mammalian species are selected to be modified (see Example below). In yet a further but less preferred embodiment, those residues involved in binding the antigen from the first mammalian species, but not the second mammalian species, are selected for modification. Such modification can involve deletion of the residue or insertion of one or more residues adjacent to the residue. However, normally the modification involves substitution of the residue for another amino acid.

Normally one would start with a conservative substitution such as those shown below under the heading of "preferred substitutions". If such substitutions result in a change in biological activity (e.g. binding affinity), then more substantial changes, denominated "exemplary substitutions" in the following table, or as further described below in reference to amino acid classes, are introduced and the products screened.

Preferred Substitutions:

| Original Residue | Exemplary Substitutions | Preferred Substitutions |
|---|---|---|
| Ala (A) | val; leu; ile | val |
| Arg (R) | lys; gln; asn | lys |
| Asn (N) | gln; his; lys; arg | gln |
| Asp (D) | glu | glu |
| Cys (C) | ser | ser |
| Gln (Q) | asn | asn |
| Glu (E) | asp | asp |
| Gly (G) | pro; ala | ala |
| His (H) | asn; gln; lys; arg | arg |
| Ile (I) | leu; val; met; ala; phe; norleucine | leu |
| Leu (L) | norleucine; ile; val; met; ala; phe | ile |
| Lys (K) | arg; gln; asn | arg |
| Met (M) | leu; phe; ile | leu |
| Phe (F) | leu; val; ile; ala; tyr | leu |
| Pro (P) | ala | ala |
| Ser (S) | thr | thr |
| Thr (T) | ser | ser |
| Trp (W) | tyr; phe | tyr |
| Tyr (Y) | trp; phe; thr; ser | phe |
| Val (V) | ile; leu; met; phe; ala; norleucine | leu |

Even more substantial modifications in the antibodies biological properties are accomplished by selecting substitutions that differ significantly in their effect on maintaining (a) the structure of the polypeptide backbone in the area of the substitution, for example, as a sheet or helical conformation, (b) the charge or hydrophobicity of the molecule at the target site, or (c) the bulk of the side chain. Naturally occurring residues are divided into groups based on common side-chain properties:

(1) hydrophobic: norleucine, met, ala, val, leu, ile;
(2) neutral hydrophilic: cys, ser, thr, asn, gln;
(3) acidic: asp, glu;
(4) basic: his, lys, arg;
(5) residues that influence chain orientation: gly, pro; and
(6) aromatic: trp, tyr, phe.

Non-conservative substitutions will entail exchanging a member of one of these classes for another class.

In another embodiment, the sites selected for modification are affinity matured using phage display (see above).

Nucleic acid molecules encoding amino acid sequence mutants are prepared by a variety of methods known in the art. These methods include, but are not limited to, oligonucleotide-mediated (or site-directed) mutagenesis, PCR mutagenesis, and cassette mutagenesis of an earlier prepared mutant or a non-mutant version of the species-dependent antibody. The preferred method for making mutants is site directed mutagenesis (see, e.g., Kunkel, *Proc. Natl. Acad. Sci. USA* 82:488 (1985)).

In certain embodiments, the antibody mutant will only have a single hypervariable region residue substituted. In other embodiments, two or more of the hypervariable region residues of the species-dependent antibody will have been substituted, e.g. from about two to about ten hypervariable region substitutions. For example, the murinized anti-VEGF antibody variant of the example below had four hypervariable region substitutions.

Ordinarily, the antibody mutant with improved biological properties will have an amino acid sequence having at least 75% amino acid sequence identity or similarity with the amino acid sequence of either the heavy or light chain variable domain of the species-dependent antibody, more preferably at least 80%, more preferably at least 85%, more preferably at least 90%, and most preferably at least 95%. Identity or similarity with respect to this sequence is defined herein as the percentage of amino acid residues in the candidate sequence that are identical (i.e same residue) or similar (i.e. amino acid residue from the same group based on common side-chain properties, see above) with the species-dependent antibody residues, after aligning the sequences and introducing gaps, if necessary, to achieve the maximum percent sequence identity. None of N-terminal, C-terminal, or internal extensions, deletions, or insertions into the antibody sequence outside of the variable domain shall be construed as affecting sequence identity or similarity.

Following production of the antibody mutant, the biological activity of that molecule relative to the species-dependent antibody is determined. As noted above, this may involve determining the binding affinity and/or other biological activities of the antibody. In a preferred embodiment of the invention, a panel of antibody mutants are prepared above and are screened for binding affinity for the antigen from the second mammalian species. One or more of the antibody mutants selected from this initial screen are optionally subjected to one or more further biological activity assays to confirm that the antibody mutant(s) with enhanced binding affinity are indeed useful, e.g. for preclinical studies. In preferred embodiments, the antibody mutant retains the ability to bind the antigen from the first mammalian species with a binding affinity similar to the species-dependent antibody. This may be achieved by avoiding altering hypervariable region residues involved in binding the antigen from the first mammalian species. In other embodiments, the antibody mutant may have a significantly altered binding affinity for the antigen from the first mammalian species (e.g. the binding affinity for that antigen is preferably better, but may be worse than the species-dependent antibody).

The antibody mutant(s) so selected may be subjected to further modifications, oftentimes depending on the intended use of the antibody. Such modifications may involve further alteration of the amino acid sequence, fusion to heterologous polypeptide(s) and/or covalent modifications such as those elaborated below. With respect to amino acid sequence alterations, exemplary modifications are elaborated above. For example, any cysteine residue not involved in maintaining the proper conformation of the antibody mutant also may be substituted, generally with serine, to improve the oxidative stability of the molecule and prevent aberrant cross linking. Conversely, cysteine bond(s) may be added to the antibody to improve its stability (particularly where the antibody is an antibody fragment such as an Fv fragment). Another type of amino acid mutant has an altered glycosylation pattern. This may be achieved by deleting one or more carbohydrate moieties found in the antibody, and/or adding one or more glycosylation sites that are not present in the antibody. Glycosylation of antibodies is typically either N-linked or O-linked. N-linked refers to the attachment of the carbohydrate moiety to the side chain of an asparagine residue. The tripeptide sequences asparagine-X-serine and asparagine-X-threonine, where X is any amino acid except proline, are the recognition sequences for enzymatic attachment of the carbohydrate moiety to the asparagine side chain. Thus, the presence of either of these tripeptide sequences in a polypeptide creates a potential glycosylation site. O-linked glycosylation refers to the attachment of one of the sugars N-aceylgalactosamine, galactose, or xylose to a hydroxyamino acid, most commonly serine or threonine, although 5-hydroxyproline or 5-hydroxylysine may also be used. Addition of glycosylation sites to the antibody is conveniently accomplished by altering the amino acid sequence such that it contains one or more of the above-described tripeptide sequences (for N-linked glycosylation sites). The alteration may also be made by the addition of, or substitution by, one or more serine or threonine residues to the sequence of the original antibody (for O-linked glycosylation sites).

Techniques for producing antibodies, which may be species-dependent and therefore require modification according to the techniques elaborated herein, follow:

A. Generation of High-Affinity Anti-VEGF Antibodies From Synthetic Antibody Phage Libraries The invention also provide a method for generating and selecting novel high-affinity anti-VEGF antibodies using a unique phage display approach. The approach involves generation of synthetic antibody phage libraries based on single framework template, design of sufficient diversities within variable domains, display of polypeptides having the diversified variable domains, selection of candidate antibodies with high affinity to target VEGF antigen, and isolation of the selected antibodies.

Details of the phage display methods can be found, for example, in the provisional U.S. Application No. 60/385,338 (filed Jun. 3, 2002) and relating applications, the entire disclosures of which are expressly incorporated herein by reference.

In one aspect, the antibody libraries used in the invention can be generated by mutating the solvent accessible and/or highly diverse positions in at least one CDR of an antibody variable domain. Some or all of the CDRs can be mutated using the methods provided herein. In some embodiments, it may be preferable to generate diverse antibody libraries by mutating positions in CDRH1, CDRH2 and CDRH3 to form a single library or by mutating positions in CDRL3 and CDRH13 to form a single library or by mutating positions in CDRL3 and CDRH1, CDRH2 and CDRH3 to form a single library.

A library of antibody variable domains can be generated, for example, having mutations in the solvent accessible and/or highly diverse positions of CDRH1, CDRH2 and CDRH3. Another library can be generated having mutations in CDRL1, CDRL2 and CDRL3. These libraries can also be used in conjunction with each other to generate binders of desired affinities. For example, after one or more rounds of selection of heavy chain libraries for binding to a target antigen, a light chain library can be replaced into the population of heavy chain binders for further rounds of selection to increase the affinity of the binders.

Preferably, a library is created by substitution of original amino acids with variant amino acids in the CDRH3 region of the variable region of the heavy chain sequence. The resulting library can contain a plurality of antibody sequences, wherein the sequence diversity is primarily in the CDRH3 region of the heavy chain sequence.

In one aspect, the library is created in the context of the humanized antibody 4D5 sequence, or the sequence of the framework amino acids of the humanized antibody 4D5 sequence. Preferably, the library is created by substitution of at least residues 95-100a of the heavy chain with amino acids encoded by the DVK codon set, wherein the DVK codon set is used to encode a set of variant amino acids for every one of these positions. An example of an oligonucleotide set that is useful for creating these substitutions comprises the sequence $(DVK)_7$. In some embodiments, a library is created by substitution of residues 95-100a with amino acids encoded by both DVK and NNK codon sets. An example of an oligonucleotide set that is useful for creating these substitutions comprises the sequence $(DVK)_6 (NNK)$. In another embodiment, a library is created by substitution of at least residues 95-100a with amino acids encoded by both DVK and NNK codon sets. An example of an oligonucleotide set that is useful for creating these substitutions comprises the sequence $(DVK)_5 (NNK)$. Another example of an oligonucleotide set that is useful for creating these substitutions comprises the sequence $(NNK)_6$. Other examples of suitable oligonucleotide sequences can be determined by one skilled in the art according to the criteria described herein.

In another embodiment, different CDRH3 designs are utilized to isolate high affinity binders and to isolate binders for a variety of epitopes. The range of lengths of CDRH3 generated in this library is 11 to 13 amino acids, although lengths different from this can also be generated. H3 diversity can be expanded by using KNK, DVK and NVK codon sets, as well as more limited diversity at N and/or C-terminal.

Diversity can also be generated in CDRH1 and CDRH2. The designs of CDR-H1 and H2 diversities follow the strategy of targeting to mimic natural antibodies repertoire as described with modification that focus the diversity more closely matched to the natural diversity than previous design.

For diversity in CDRH3, multiple libraries can be constructed separately with different lengths of H3 and then combined to select for binders to target antigens. The multiple libraries can be pooled and sorted using solid support selection and solution sorting methods as described previously and herein below. Multiple sorting strategies may be employed. For example, one variation involves sorting on target bound to a solid, followed by sorting for a tag that may be present on the fusion polypeptide (e.g. anti-gD tag) and followed by another sort on target bound to solid. Alternatively, the libraries can be sorted first on target bound to a solid surface, the eluted binders are then sorted using solution phase binding with decreasing concentrations of target antigen. Utilizing combinations of different sorting methods provides for minimization of selection of only highly expressed sequences and provides for selection of a number of different high affinity clones.

High affinity binders for the target VEGF antigen can be isolated from the libraries. Limiting diversity in the H1/H2 region decreases degeneracy about $10^4$ to $10^5$ fold and allowing more H3 diversity provides for more high affinity binders. Utilizing libraries with different types of diversity in CDRH3 (e.g. utilizing DVK or NVT) provides for isolation of binders that may bind to different epitopes of a target antigen.

Of the binders isolated from the pooled libraries as described above, it has been discovered that affinity may be further improved by providing limited diversity in the light chain. Light chain diversity is generated in this embodiment as follows in CDRL1: amino acid position 28 is encoded by RDT; amino acid position 29 is encoded by RKT; amino acid position 30 is encoded by RVW; amino acid position 31 is encoded by ANW; amino acid position 32 is encoded by THT; optionally, amino acid position 33 is encoded by CTG; in CDRL2: amino acid position 50 is encoded by KBG; amino acid position 53 is encoded by AVC; and optionally, amino acid position 55 is encoded by GMA; in CDRL3: amino acid position 91 is encoded by TMT or SRT or both; amino acid position 92 is encoded by DMC; amino acid position 93 is encoded by RVT; amino acid position 94 is encoded by NHT; and amino acid position 96 is encoded by TWT or YKG or both.

In another embodiment, a library or libraries with diversity in CDRH1, CDRH2 and CDRH3 regions is generated. In this embodiment, diversity in CDRH3 is generated using a variety of lengths of H3 regions and using primarily codon sets XYZ and NNK or NNS. Libraries can be formed using individual oligonucleotides and pooled or oligonucleotides can be pooled to form a subset of libraries. The libraries of this embodiment can be sorted against target bound to solid. Clones isolated from multiple sorts can be screened for specificity and affinity using ELISA assays. For specificity, the clones can be screened against the desired target antigens as well as other nontarget antigens. Those binders to the target VEGF antigen can then be screened for affinity in solution binding competition ELISA assay or spot competition assay. High affinity binders can be isolated from the library utilizing XYZ codon sets prepared as described above. These binders can be readily produced as antibodies or antigen binding fragments in high yield in cell culture.

In some embodiments, it may be desirable to generate libraries with a greater diversity in lengths of CDRH3 region. For example, it may be desirable to generate libraries with CDRH3 regions ranging from about 7 to 19 amino acids.

High affinity binders isolated from the libraries of these embodiments are readily produced in bacterial and eukaryotic cell culture in high yield. The vectors can be designed to readily remove sequences such as gD tags, viral coat protein component sequence, and/or to add in constant region sequences to provide for production of full length antibodies or antigen binding fragments in high yield.

A library with mutations in CDRH3 can be combined with a library containing variant versions of other CDRs, for example CDRL1, CDRL2, CDRL3, CDRH1 and/or CDRH2. Thus, for example, in one embodiment, a CDRH3 library is combined with a CDRL3 library created in the context of the humanized 4D5 antibody sequence with variant amino acids at positions 28, 29, 30,31, and/or 32 using predetermined codon sets. In another embodiment, a library with mutations to the CDRH3 can be combined with a library comprising variant CDRH1 and/or CDRH2 heavy chain variable domains. In one embodiment, the CDRH1 library is created with the humanized antibody 4D5 sequence with variant amino acids at positions 28, 30, 31, 32 and 33. A CDRH2 library may be created with the sequence of humanized antibody 4D5 with variant amino acids at positions 50, 52, 53, 54, 56 and 58 using the predetermined codon sets.

B. Vectors, Host Cells and Recombinant Methods

The anti-VEGF antibody of the invention can be produced recombinantly, using techniques and materials readily obtainable.

For recombinant production of an anti-VEGF antibody, the nucleic acid encoding it is isolated and inserted into a replicable vector for further cloning (amplification of the DNA) or for expression. DNA encoding the antibody is readily isolated or synthethized using conventional procedures (e.g., by using oligonucleotide probes that are capable of binding specifically to DNAs encoding the heavy and light chains of the antibody). Many vectors are available. The vector components generally include, but are not limited to, one or more of the following: a signal sequence, an origin of replication, one or more marker genes, an enhancer element, a promoter, and a transcription termination sequence.

(i) Signal Sequence Component

The antibody of this invention may be produced recombinantly not only directly, but also as a fusion polypeptide with a heterologous polypeptide, which is preferably a signal sequence or other polypeptide having a specific cleavage site at the N-terminus of the mature protein or polypeptide. The heterologous signal sequence selected preferably is one that is recognized and processed (i.e., cleaved by a signal peptidase) by the host cell. For prokaryotic host cells that do not recognize and process the native antibody signal sequence, the signal sequence is substituted by a prokaryotic signal sequence selected, for example, from the group of the alkaline phosphatase, penicillinase, lpp, or heat-stable enterotoxin II leaders. For yeast secretion the native signal sequence may be substituted by, e.g., the yeast invertase leader, α factor leader (including *Saccharomyces* and *Kluyveromyces* α-factor leaders), or acid phosphatase leader, the *C. albicans* glucoamylase leader, or the signal described in WO 90/13646. In mammalian cell expression, mammalian signal sequences as well as viral secretory leaders, for example, the herpes simplex gD signal, are available.

The DNA for such precursor region is ligated in reading frame to DNA encoding the antibody.

(ii) Origin of Replication Component

Both expression and cloning vectors contain a nucleic acid sequence that enables the vector to replicate in one or more selected host cells. Generally, in cloning vectors this sequence is one that enables the vector to replicate independently of the host chromosomal DNA, and includes origins of replication or autonomously replicating sequences. Such sequences are well known for a variety of bacteria, yeast, and viruses. The origin of replication from the plasmid pBR322 is suitable for most Gram-negative bacteria, the 2μ plasmid origin is suitable for yeast, and various viral origins (SV40, polyoma, adenovirus, VSV or BPV) are useful for cloning vectors in mammalian cells. Generally, the origin of replication component is not needed for mammalian expression vectors (the SV40 origin may typically be used only because it contains the early promoter).

(iii) Selection Gene Component

Expression and cloning vectors may contain a selection gene, also termed a selectable marker. Typical selection genes encode proteins that (a) confer resistance to antibiotics or other toxins, e.g., ampicillin, neomycin, methotrexate, or tetracycline, (b) complement auxotrophic deficiencies, or (c) supply critical nutrients not available from complex media, e.g., the gene encoding D-alanine racemase for *Bacilli*.

One example of a selection scheme utilizes a drug to arrest growth of a host cell. Those cells that are successfully transformed with a heterologous gene produce a protein conferring drug resistance and thus survive the selection regimen. Examples of such dominant selection use the drugs neomycin, mycophenolic acid and hygromycin.

Another example of suitable selectable markers for mammalian cells are those that enable the identification of cells competent to take up the antibody nucleic acid, such as DHFR, thymidine kinase, metallothionein-I and -II, preferably primate metallothionein genes, adenosine deaminase, ornithine decarboxylase, etc.

For example, cells transformed with the DHFR selection gene are first identified by culturing all of the transformants in a culture medium that contains methotrexate (Mtx), a competitive antagonist of DHFR. An appropriate host cell when wild-type DHFR is employed is the Chinese hamster ovary (CHO) cell line deficient in DHFR activity.

Alternatively, host cells (particularly wild-type hosts that contain endogenous DHFR) transformed or co-transformed with DNA sequences encoding antibody, wild-type DHFR protein, and another selectable marker such as aminoglycoside 3'-phosphotransferase (APH) can be selected by cell growth in medium containing a selection agent for the selectable marker such as an aminoglycosidic antibiotic, e.g., kanamycin, neomycin, or G418. See U.S. Pat. No. 4,965,199.

A suitable selection gene for use in yeast is the trp1 gene present in the yeast plasmid YRp7 (Stinchcomb et al., *Nature*, 282:39 (1979)). The trp1 gene provides a selection marker for a mutant strain of yeast lacking the ability to grow in tryptophan, for example, ATCC No. 44076 or PEP4-1. Jones, *Genetics*, 85:12 (1977). The presence of the trp1 lesion in the yeast host cell genome then provides an effective environment for detecting transformation by growth in the absence of tryptophan. Similarly, Leu2-deficient yeast strains (ATCC 20,622 or 38,626) are complemented by known plasmids bearing the Leu2 gene.

In addition, vectors derived from the 1.6 μm circular plasmid pKD1 can be used for transformation of *Kluyveromyces* yeasts. Alternatively, an expression system for large-scale production of recombinant calf chymosin was reported for *K. lactis*. Van den Berg, *Bio/Technotogy*, 8:135 (1990). Stable multi-copy expression vectors for secretion of mature recombinant human serum albumin by industrial strains of *Kluyveromyces* have also been disclosed. Fleer et al., *Bio/Technology*, 9:968-975 (1991).

(iv) Promoter Component

Expression and cloning vectors usually contain a promoter that is recognized by the host organism and is operably linked to the antibody nucleic acid. Promoters suitable for use with prokaryotic hosts include the phoA promoter, β-lactamase and lactose promoter systems, alkaline phosphatase, a tryptophan (trp) promoter system, and hybrid promoters such as the tac promoter. However, other known bacterial promoters are suitable. Promoters for use in bacterial systems also will contain a Shine-Dalgarno (S.D.) sequence operably linked to the DNA encoding the antibody.

Promoter sequences are known for eukaryotes. Virtually all eukaryotic genes have an AT-rich region located approximately 25 to 30 bases upstream from the site where transcription is initiated. Another sequence found 70 to 80 bases upstream from the start of transcription of many genes is a CNCAAT region where N may be any nucleotide. At the 3' end of most eukaryotic genes is an AATAAA sequence that may be the signal for addition of the poly A tail to the 3' end of the coding sequence. All of these sequences are suitably inserted into eukaryotic expression vectors.

Examples of suitable promoting sequences for use with yeast hosts include the promoters for 3-phosphoglycerate kinase or other glycolytic enzymes, such as enolase, glyceraldehyde-3-phosphate dehydrogenase, hexokinase, pyruvate decarboxylase, phosphofructokinase, glucose-6-phosphate isomerase, 3-phosphoglycerate mutase, pyruvate kinase, triosephosphate isomerase, phosphoglucose isomerase, and glucokinase.

Other yeast promoters, which are inducible promoters having the additional advantage of transcription controlled by growth conditions, are the promoter regions for alcohol dehydrogenase 2, isocytochrome C, acid phosphatase, degradative enzymes associated with nitrogen metabolism, metallothionein, glyceraldehyde-3-phosphate dehydrogenase, and enzymes responsible for maltose and galactose utilization. Suitable vectors and promoters for use in yeast expression are further described in EP 73,657. Yeast enhancers also are advantageously used with yeast promoters.

Antibody transcription from vectors in mammalian host cells is controlled, for example, by promoters obtained from the genomes of viruses such as polyoma virus, fowlpox virus, adenovirus (such as Adenovirus 2), bovine papilloma virus, avian sarcoma virus, cytomegalovirus, a retrovirus, hepatitis-B virus and most preferably Simian Virus 40 (SV40), from heterologous mammalian promoters, e.g., the actin promoter or an immunoglobulin promoter, from heat-shock promoters, provided such promoters are compatible with the host cell systems.

The early and late promoters of the SV40 virus are conveniently obtained as an SV40 restriction fragment that also contains the SV40 viral origin of replication. The immediate early promoter of the human cytomegalovirus is conveniently obtained as a HindIII E restriction fragment. A system for expressing DNA in mammalian hosts using the bovine papilloma virus as a vector is disclosed in U.S. Pat. No. 4,419,446. A modification of this system is described in U.S. Pat. No. 4,601,978. See also Reyes et al., *Nature* 297:598-601 (1982) on expression of human β-interferon cDNA in mouse cells under the control of a thymidine kinase promoter from herpes simplex virus. Alternatively, the rous sarcoma virus long terminal repeat can be used as the promoter.

(v) Enhancer Element Component

Transcription of a DNA encoding the antibody of this invention by higher eukaryotes is often increased by inserting an enhancer sequence into the vector. Many enhancer sequences are now known from mammalian genes (globin, elastase, albumin, α-fetoprotein, and insulin). Typically, however, one will use an enhancer from a eukaryotic cell virus. Examples include the SV40 enhancer on the late side of the replication origin (bp 100-270), the cytomegalovirus early promoter enhancer, the polyoma enhancer on the late side of the replication origin, and adenovirus enhancers. See also Yaniv, *Nature* 297:17-18 (1982) on enhancing elements for activation of eukaryotic promoters. The enhancer may be spliced into the vector at a position 5' or 3' to the antibody-encoding sequence, but is preferably located at a site 5' from the promoter.

(vi) Transcription Termination Component

Expression vectors used in eukaryotic host cells (yeast, fungi, insect, plant, animal, human, or nucleated cells from other multicellular organisms) will also contain sequences necessary for the termination of transcription and for stabilizing the mRNA. Such sequences are commonly available from the 5' and, occasionally 3', untranslated regions of eukaryotic or viral DNAs or cDNAs. These regions contain nucleotide segments transcribed as polyadenylated fragments in the untranslated portion of the mRNA encoding the antibody. One useful transcription termination component is the bovine growth hormone polyadenylation region. See WO94/11026 and the expression vector disclosed therein.

(vii) Selection and Transformation of Host Cells

Suitable host cells for cloning or expressing the DNA in the vectors herein are the prokaryote, yeast, or higher eukaryote cells described above. Suitable prokaryotes for this purpose include eubacteria, such as Gram-negative or Gram-positive organisms, for example, Enterobacteriaceae such as *Escherichia*, e.g., *E. coli, Enterobacter, Envinia, Klebsiella, Proteus, Salmonella*, e.g., *Salmonella typhimurium, Serratia*, e.g., *Serratia marcescans*, and *Shigella*, as well as *Bacilli* such as *B. subtilis* and *B. licheniformis* (e.g., *B. licheniformis* 41 P disclosed in DD 266,710 published 12 Apr. 1989), *Pseudomonas* such as *P. aeruginosa*, and *Streptomyces*. One preferred *E. coli* cloning host is *E. coli* 294 (ATCC 31,446), although other strains such as *E. coli* B, *E. coli* X1776 (ATCC 31,537), and *E. coli* W3110 (ATCC 27,325) are suitable. These examples are illustrative rather than limiting.

In addition to prokaryotes, eukaryotic microbes such as filamentous fungi or yeast are suitable cloning or expression hosts for antibody-encoding vectors. *Saccharomyces cerevisiae*, or common baker's yeast, is the most commonly used among lower eukaryotic host microorganisms. However, a number of other genera, species, and strains are commonly available and useful herein, such as *Schizosacchaiomyces pombe; Kluyveromyces* hosts such as, e.g., *K. lactis, K. fragilis* (ATCC 12,424), *K. bulgaricus* (ATCC 16,045), *K. wickeramii* (ATCC 24,178), *K. waltii* (ATCC 56,500), *K. drosophilarum* (ATCC 36,906), *K. thermotolerans*, and *K. marxianus, yarrowia* (EP 402,226); *Pichia pastoris* (EP 183, 070); *Candida; Trichoderma reesia* (EP 244,234); *Neurospora crassa; Schwanniomyces* such as *Schwanniomyces occidentalis*; and filamentous fungi such as, e.g., *Neurospora, Penicillium, Tolypocladium*, and *Aspergillus* hosts such as *A. nidulans* and *A. niger*.

Suitable host cells for the expression of glycosylated antibody are derived from multicellular organisms. Examples of invertebrate cells include plant and insect cells. Numerous baculoviral strains and variants and corresponding permissive insect host cells from hosts such as *Spodoptera frugiperda* (caterpillar), *Aedes aegypti* (mosquito), *Aedes albopictus* (mosquito), *Drosophila melanogaster* (fruitfly), and *Bombyx mori* have been identified. A variety of viral strains for transfection are publicly available, e.g., the L-1 variant of *Autographa californica* NPV and the Bm-5 strain of *Bombyx mori* NPV, and such viruses may be used as the virus herein according to the present invention, particularly for transfection of *Spodoptera frugiperda* cells. Plant cell cultures of cotton, corn, potato, soybean, petunia, tomato, and tobacco can also be utilized as hosts.

However, interest has been greatest in vertebrate cells, and propagation of vertebrate cells in culture (tissue culture) has become a routine procedure. Examples of useful mammalian host cell lines are monkey kidney CV1 line transformed by SV40 (COS-7, ATCC CRL 1651); human embryonic kidney line (293 or 293 cells subcloned for growth in suspension culture, Graham et al., *J. Gen Virol.* 36:59 (1977)); baby hamster kidney cells (BHK, ATCC CCL 10); Chinese hamster ovary cells/-DHFR (CHO, Urlaub et al., *Proc. Natl. Acad. Sci, USA* 77:4216 (1980)); mouse sertoli cells (TM4, Mather, *Biol. Reprod.* 23:243-251 (1980) ); monkey kidney cells (CV1 ATCC CCL 70); African green monkey kidney cells (VERO-76, ATCC CRL-1587); human cervical carcinoma cells (HELA, ATCC CCL 2); canine kidney cells (MDCK, ATCC CCL 34); buffalo rat liver cells (BRL 3A, ATCC CRL 1442); human lung cells (W138, ATCC CCL 75); human liver cells (Hep G2, HB 8065); mouse mammary tumor (MMT 060562, ATCC CCL51); TRI cells (Mather et al., *Annals N.Y. Acad. Sci.* 383:44-68 (1982)); MRC 5 cells; FS4 cells; and a human hepatoma line (Hep G2).

Host cells are transformed with the above-described expression or cloning vectors for antibody production and cultured in conventional nutrient media modified as appropriate for inducing promoters, selecting transformants, or amplifying the genes encoding the desired sequences.

(viii) Culturing the Host Cells

The host cells used to produce the antibody of this invention may be cultured in a variety of media. Commercially available media such as Ham's F10 (Sigma), Minimal Essential Medium ((MEM), (Sigma), RPMI-1640 (Sigma), and Dulbecco's Modified Eagle's Medium ((DMEM), Sigma) are suitable for culturing the host cells. In addition, any of the media described in Ham et al., *Meth. Enz.* 58:44 (1979), Bames et al., *Anal. Biochem.* 102:255 (1980), U.S. Pat. Nos. 4,767,704; 4,657,866; 4,927,762; 4,560,655; or 5,122,469; WO 90/03430; WO 87/00195; or U.S. Pat. Re. 30,985 may be used as culture media for the host cells. Any of these media may be supplemented as necessary with hormones and/or other growth factors (such as insulin, transferrin, or epidermal growth factor), salts (such as sodium chloride, calcium, magnesium, and phosphate), buffers (such as HEPES), nucleotides (such as adenosine and thymidine), antibiotics (such as GENTAMYCIN™ drug), trace elements (defined as inorganic compounds usually present at final concentrations in the micromolar range), and glucose or an equivalent energy source. Any other necessary supplements may also be included at appropriate concentrations that would be known to those skilled in the art. The culture conditions, such as temperature, pH, and the like, are those previously used with the host cell selected for expression, and will be apparent to the ordinarily skilled artisan.

(ix) Antibody Purification

When using recombinant techniques, the antibody can be produced intracellularly, in the periplasmic space, or directly secreted into the medium. If the antibody is produced intracellularly, as a first step, the particulate debris, either host cells or lysed fragments, is removed, for example, by centrifugation or ultrafiltration. Carter et al., *Bio/Technology* 10:163-167 (1992) describe a procedure for isolating antibodies which are secreted to the periplasmic space of *E. coli*. Briefly, cell paste is thawed in the presence of sodium acetate (pH3.5), EDTA, and phenylmethylsulfonylfluoride (PMSF) over about 30 min. Cell debris can be removed by centrifugation. Where the antibody is secreted into the medium, supernatants from such expression systems are generally first concentrated using a commercially available protein concentration filter, for example, an Amicon or Millipore Pellicon ultrafiltration unit. A protease inhibitor such as PMSF may be included in any of the foregoing steps to inhibit proteolysis and antibiotics may be included to prevent the growth of adventitious contaminants.

The antibody composition prepared from the cells can be purified using, for example, hydroxylapatite chromatography, gel electrophoresis, dialysis, and affinity chromatography, with affinity chromatography being the preferred purification technique. The suitability of protein A as an affinity ligand depends on the species and isotype of any immunoglobulin Fc domain that is present in the antibody. Protein A can be used to purify antibodies that are based on human γ1, γ2, or γ4 heavy chains (Lindmark et al., *J. Immunol. Meth.* 62:1-13 (1983)). Protein G is recommended for all mouse isotypes and for human γ3 (Guss et al., *EMBO J.* 5:15671575 (1986)). The matrix to which the affinity ligand is attached is most often agarose, but other matrices are available. Mechanically stable matrices such as controlled pore glass or poly(styrenedivinyl)benzene allow for faster flow rates and shorter processing times than can be achieved with agarose. Where the antibody comprises a $C_H3$ domain, the Bakerbond ABX™ resin (J. T. Baker, Phillipsburg, N.J.) is useful for purification. Other techniques for protein purification such as fractionation on an ion-exchange column, ethanol precipitation, Reverse Phase HPLC, chromatography on silica, chromatography on heparin SEPHAROSE™ chromatography on an anion or cation exchange resin (such as a polyaspartic acid column), chromatofocusing, SDS-PAGE, and ammonium sulfate precipitation are also available depending on the antibody to be recovered.

Following any preliminary purification step(s), the mixture comprising the antibody of interest and contaminants may be subjected to low pH hydrophobic interaction chromatography using an elution buffer at a pH between about 2.5-4.5, preferably performed at low salt concentrations (e.g., from about 0-0.25M salt).

C. Pharmaceutical Formulations

Therapeutic formulations of the antibody are prepared for storage by mixing the antibody having the desired degree of purity with optional physiologically acceptable carriers, excipients or stabilizers (*Remington's Pharmaceutical Sciences* 16th edition, Osol, A. Ed. (1980)), in the form of lyophilized formulations or aqueous solutions. Acceptable carriers, excipients, or stabilizers are nontoxic to recipients at the dosages and concentrations employed, and include buffers such as phosphate, citrate, and other organic acids; antioxidants including ascorbic acid and methionine; preservatives (such as octadecyldimethylbenzyl ammonium chloride; hexamethonium chloride; benzalkonium chloride, benzethonium chloride; phenol, butyl or benzyl alcohol; alkyl parabens such as methyl or propyl paraben; catechol; resorcinol; cyclohexanol; 3-pentanol; and m-cresol); low molecular weight (less than about 10 residues) polypeptide; proteins, such as serum albumin, gelatin, or immunoglobulins; hydrophilic polymers such as polyvinylpyrrolidone; amino acids such as glycine, glutamine, asparagine, histidine, arginine, or lysine; monosaccharides, disaccharides, and other carbohydrates including glucose, mannose, or dextrins; chelating agents such as EDTA; sugars such as sucrose, mannitol, trehalose or sorbitol; salt-forming counter-ions such as sodium; metal complexes (e.g., Zn-protein complexes); and/or non-ionic surfactants such as TWEEN™, PLURONICS™ or polyethylene glycol (PEG).

The formulation herein may also contain more than one active compound as necessary for the particular indication being treated, preferably those with complementary activities that do not adversely affect each other. For example, it may be desirable to further provide an immunosuppressive agent. Such molecules are suitably present in combination in amounts that are effective for the purpose intended.

The active ingredients may also be entrapped in microcapsule prepared, for example, by coacervation techniques or by interfacial polymerization, for example, hydroxymethylcellulose or gelatin-microcapsule and poly-(methylmethacylate) microcapsule, respectively, in colloidal drug delivery systems (for example, liposomes, albumin microspheres, microemulsions, nano-particles and nanocapsules) or in macroemulsions. Such techniques are disclosed in *Remington's Pharmaceutical Sciences* 16th edition, Osol, A. Ed. (1980).

The formulations to be used for in vivo administration must be sterile. This is readily accomplished by filtration through sterile filtration membranes.

Sustained-release preparations may be prepared. Suitable examples of sustained-release preparations include semipermeable matrices of solid hydrophobic polymers containing the antibody, which matrices are in the form of shaped articles, e.g., films, or microcapsule. Examples of sustained-release matrices include polyesters, hydrogels (for example, poly(2-hydroxyethyl-methacrylate), or poly(vinylalcohol)), polylactides (U.S. Pat. No. 3,773,919), copolymers of L-glutamic acid and γ ethyl-L-glutamate, non-degradable ethylene-vinyl acetate, degradable lactic acid-glycolic acid copolymers such as the LUPRON DEPOT™ (injectable microspheres composed of lactic acid-glycolic acid copolymer and leuprolide acetate), and poly-D-(-)-3-hydroxybutyric acid. While polymers such as ethylene-vinyl acetate and lactic acid-glycolic acid enable release of molecules for over 100 days, certain hydrogels release proteins for shorter time periods. When encapsulated antibodies remain in the body for a long time, they may denature or aggregate as a result of exposure to moisture at 37° C., resulting in a loss of biological activity and possible changes in immunogenicity. Rational strategies can be devised for stabilization depending on the mechanism involved. For example, if the aggregation mechanism is discovered to be intermolecular S—S bond formation through thio-disulfide interchange, stabilization may be achieved by modifying sulfhydryl residues, lyophilizing from acidic solutions, controlling moisture content, using appropriate additives, and developing specific polymer matrix compositions.

D. Non-Therapeutic Uses for the Antibody

The antibodies of the invention may be used as affinity purification agents. In this process, the antibodies are immobilized on a solid phase such a Sephadex resin or filter paper, using methods well known in the art. The immobilized antibody is contacted with a sample containing the antigen to be purified, and thereafter the support is washed with a suitable solvent that will remove substantially all the material in the sample except the antigen to be purified, which is bound to the immobilized antibody. Finally, the support is washed with another suitable solvent, such as glycine buffer, pH 5.0, that will release the antigen from the antibody.

The antibodies of this invention may also be useful in diagnostic assays, e.g., for detecting expression of an antigen of interest in specific cells, tissues, or serum.

For diagnostic applications, the antibody typically will be labeled with a detectable moiety. Numerous labels are available which can be generally grouped into the following categories:

(a) Radioisotopes, such as $^{35}S$, $^{14}C$, $^{125}I$, $^{3}H$, and $^{131}I$. The antibody can be labeled with the radioisotope using the techniques described in *Current Protocols in Immunology*, Volumes 1 and 2, Coligen et al., Ed. Wiley-Interscience, New York, N.Y., Pubs. (1991) for example and radioactivity can be measured using scintillation counting.

(b) Fluorescent labels such as rare earth chelates (europium chelates) or fluorescein and its derivatives, rhodamine and its derivatives, dansyl, Lissamine, phycoerythrin and Texas Red are available. The fluorescent labels can be conjugated to the antibody using the techniques disclosed in *Current Protocols in Immunology*, supra, for example. Fluorescence can be quantified using a fluorimeter.

(c) Various enzyme-substrate labels are available and U.S. Pat. No. 4,275,149 provides a review of some of these. The enzyme generally catalyzes a chemical alteration of the chromogenic substrate which can be measured using various techniques. For example, the enzyme may catalyze a color change in a substrate, which can be measured spectrophotometrically. Alternatively, the enzyme may alter the fluorescence or chemiluminescence of the substrate. Techniques for quantifying a change in fluorescence are described above. The chemiluminescent substrate becomes electronically excited by a chemical reaction and may then emit light which can be measured (using a chemiluminometer, for example) or donates energy to a fluorescent acceptor. Examples of enzymatic labels include luciferases (e.g., firefly luciferase and bacterial luciferase; U.S. Pat. No. 4,737,456), luciferin, 2,3-dihydrophthalazinediones, malate dehydrogenase, urease, peroxidase such as horseradish peroxidase (HRPO), alkaline phosphatase, β-galactosidase, glucoamylase, lysozyme, saccharide oxidases (e.g., glucose oxidase, galactose oxidase, and glucose-6-phosphate dehydrogenase), heterocyclic oxidases (such as uricase and xanthine oxidase), lactoperoxidase, microperoxidase, and the like. Techniques for conjugating enzymes to antibodies are described in O'Sullivan et al., Methods for the Preparation of Enzyme-Antibody Conjugates for use in Enzyme Immunoassay, in *Methods in Enzym.* (ed J. Langone & H. Van Vunakis), Academic press, New York, 73:147-166 (1981).

Examples of enzyme-substrate combinations include, for example:

(i) Horseradish peroxidase (HRPO) with hydrogen peroxidase as a substrate, wherein the hydrogen peroxidase oxidizes a dye precursor (e.g., orthophenylene diamine (OPD) or 3,3', 5,5'-tetramethyl benzidine hydrochloride (TMB));

(ii) alkaline phosphatase (AP) with para-Nitrophenyl phosphate as chromogenic substrate; and (iii) β-D-galactosidase (β-D-Gal) with a chromogenic substrate (e.g., p-nitrophenyl-β-D-galactosidase) or fluorogenic substrate 4-methylumbelliferyl-β-D-galactosidase.

Numerous other enzyme-substrate combinations are available to those skilled in the art. For a general review of these, see U.S. Pat. Nos. 4,275,149 and 4,318,980.

Sometimes, the label is indirectly conjugated with the antibody. The skilled artisan will be aware of various techniques for achieving this. For example, the antibody can be conjugated with biotin and any of the three broad categories of labels mentioned above can be conjugated with avidin, or vice versa. Biotin binds selectively to avidin and thus, the label can be conjugated with the antibody in this indirect manner. Alternatively, to achieve indirect conjugation of the label with the antibody, the antibody is conjugated with a small hapten (e.g., digoxin) and one of the different types of labels mentioned above is conjugated with an anti-hapten antibody (e.g., anti-digoxin antibody). Thus, indirect conjugation of the label with the antibody can be achieved.

In another embodiment of the invention, the antibody need not be labeled, and the presence thereof can be detected using a labeled antibody which binds to the antibody.

The antibodies of the present invention may be employed in any known assay method, such as competitive binding assays, direct and indirect sandwich assays, and immunoprecipitation assays. Zola, *Monoclonal Antibodies: A Manual of Techniques*, pp. 147-158 (CRC Press, Inc. 1987).

Competitive binding assays rely on the ability of a labeled standard to compete with the test sample analyze for binding with a limited amount of antibody. The amount of antigen in the test sample is inversely proportional to the amount of standard that becomes bound to the antibodies. To facilitate determining the amount of standard that becomes bound, the antibodies generally are insolubilized before or after the competition, so that the standard and analyze that are bound to the antibodies may conveniently be separated from the standard and analyze which remain unbound.

Sandwich assays involve the use of two antibodies, each capable of binding to a different immunogenic portion, or epitope, of the protein to be detected. In a sandwich assay, the test sample analyze is bound by a first antibody which is immobilized on a solid support, and thereafter a second antibody binds to the analyze, thus forming an insoluble three-part complex. See, e.g., U.S. Pat. No. 4,376,110. The second antibody may itself be labeled with a detectable moiety (direct sandwich assays) or may be measured using an anti-immunoglobulin antibody that is labeled with a detectable moiety (indirect sandwich assay). For example, one type of sandwich assay is an ELISA assay, in which case the detectable moiety is an enzyme.

For immunohistochemistry, the tumor sample may be fresh or frozen or may be embedded in paraffin and fixed with a preservative such as formalin, for example.

The antibodies may also be used for in vivo diagnostic assays. Generally, the antibody is labeled with a radionuclide (such as $^{111}$In, $^{99}$Tc, $^{14}$C, $^{131}$I, $^{125}$I, $^{3}$H, $^{32}$P or $^{35}$S) or a dye so that the tumor can be localized using immunoscintiography.

In one embodiment, a method of detecting VEGF in a biological sample (e.g., tissue, blood, sera, spinal fluid) or a prepared biological sample can comprise the step of contacting an antibody of this invention with the sample and observing the anti-VEGF antibody bound to the VEGF in the sample or determining the amount of the anti-VEGF antibody bound to VEGF in the sample. In another embodiment, a method of detecting VEGF in a subject comprises the step of administering an antibody of this invention to the subject and observing the anti-VEGF antibody bound to the VEGF in the subject or determining the amount of the anti-VEGF antibody bound to VEGF in the subject (e.g., human, mouse, rabbit, rat, etc).

E. Diagnostic Kits

As a matter of convenience, the antibody of the present invention can be provided in a kit, i.e., a packaged combination of reagents in predetermined amounts with instructions for performing the diagnostic assay. Where the antibody is labeled with an enzyme, the kit will include substrates and cofactors required by the enzyme (e.g., a substrate precursor which provides the detectable chromophore or fluorophore). In addition, other additives may be included such as stabilizers, buffers (e.g., a block buffer or lysis buffer) and the like. The relative amounts of the various reagents may be varied widely to provide for concentrations in solution of the reagents which substantially optimize the sensitivity of the assay. Particularly, the reagents may be provided as dry powders, usually lyophilized, including excipients which on dissolution will provide a reagent solution having the appropriate concentration.

F. In Vivo Uses for the Antibody

It is contemplated that the antibody of the present invention may be used to treat a mammal. In one embodiment, the antibody is administered to a nonhuman mammal for the purposes of obtaining preclinical data, for example. Exemplary nonhuman mammals to be treated include nonhuman primates, dogs, cats, rodents and other mammals in which preclinical studies are performed. Such mammals may be established animal models for a disease to be treated with the antibody or may be used to study toxicity of the antibody of interest. In each of these embodiments, dose escalation studies may be performed in the mammal. Where the antibody is an anti-VEGF antibody, it may be administered to a host rodent in a solid tumor model, for example.

In addition, or in the alternative, the antibody is used to treat a human, e.g. a patient suffering from a disease or disorder who could benefit from administration of the antibody. The conditions which can be treated with the antibody are many and include conditions arising from or exacerbated by abnormal angiogenesis, e.g., by excessive, inappropriate or uncontrolled angiogenesis. For example, such conditions include, cancer such as colorectal cancer and NSCLS and others described above and inflammatory diseases such as rheumatoid arthritis and others described above.

The following references describe lymphomas and CLL, their diagnoses, treatment and standard medical procedures for measuring treatment efficacy. Canellos G P, Lister, T A, Sklar J L: The Lymphomas. W.B. Saunders Company, Philadelphia, 1998; van Besien K and Cabanillas, F: Clinical Manifestations, Staging and Treatment of Non-Hodgkin's Lymphoma, Chap. 70, pp 1293-1338, in: Hematology, Basic Principles and Practice, 3rd ed. Hoffman et al. (editors). Churchill Livingstone, Philadelphia, 2000; and Rai, K and Patel, D:Chronic Lymphocytic Leukemia, Chap. 72, pp 1350-1362, in: Hematology, Basic Principles and Practice, 3rd ed. Hoffman et al. (editors). Churchill Livingstone, Philadelphia, 2000.

The parameters for assessing efficacy or success of treatment of an autoimmune or autoimmune related disease will be known to the physician of skill in the appropriate disease. Generally, the physician of skill will look for reduction in the signs and symptoms of the specific disease. The following are by way of examples.

In one embodiment, the methods and compositions of the invention are useful to treat rheumatoid arthritis. RA is characterized by inflammation of multiple joints, cartilage loss and bone erosion that leads to joint destruction and ultimately reduced joint function. Additionally, since RA is a systemic disease, it can have effects in other tissues such as the lungs, eyes and bone marrow.

The VEGF binding antibodies can be used as first-line therapy in patients with early RA (i.e., methotrexate (MTX) naive), or in combination with, e.g., MTX or cyclophosphamide. Or, the antibodies can be used in treatment as second-line therapy for patients who were DMARD and/or MTX refractory, in combination with, e.g., MTX. In one preferred embodiment, the VEGF binding antibodies of this invention are administered to mammals who are DMARD and/or MTX refractory. The anti-VEGF antibodies are useful to prevent and control joint damage, delay structural damage, decrease pain associated with inflammation in RA, and generally reduce the signs and symptoms in moderate to severe RA. The RA patient can be treated with the anti-VEGF antibodies of this invention prior to, after or together with treatment with other drugs used in treating RA (see combination therapy below). In one embodiment, patients who had previously failed disease-modifying antirheumatic drugs and/or had an inadequate response to methotrexate alone are treated with an anti-VEGF binding antibody. In another embodiment, the patients are administered an anti-VEGF antibody of this invention plus cyclophosphamide or anti-VEGF binding antibody plus methotrexate.

One method of evaluating treatment efficacy in RA is based on American College of Rheumatology (ACR) criteria, which measures the percentage of improvement in tender and swollen joints, among other things. The RA patient can be scored at for example, ACR 20 (20 percent improvement) compared with no antibody treatment (e.g., baseline before treatment) or treatment with placebo. Other ways of evaluating the efficacy of antibody treatment include X-ray scoring such as the Sharp X-ray score used to score structural damage such as bone erosion and joint space narrowing. Patients can also be evaluated for the prevention of or improvement in disability based on Health Assessment Questionnaire [HAQ] score, AIMS score, SF-36 at time periods during or after treatment. The ACR 20 criteria may include 20% improvement in both tender (painful) joint count and swollen joint count plus a 20% improvement in at least 3 of 5 additional measures:

1. patient's pain assessment by visual analog scale (VAS), 2. patient's global assessment of disease activity (VAS), 3. physician's global assessment of disease activity (VAS), 4. patient's self-assessed disability measured by the Health Assessment Questionnaire, and 5. acute phase reactants, CRP or ESR.

The ACR 50 and 70 are defined analogously. Preferably, the patient is administered an amount of anti-VEGF binding antibody of the invention alone or in combination with other agents for treating rheumatoid arthritis effective to achieve at least a score of ACR 20, preferably at least ACR 30, more preferably at least ACR50, even more preferably at least ACR70, most preferably at least ACR 75 and higher.

Psoriatic arthritis has unique and distinct radiographic features. For psoriatic arthritis, joint erosion and joint space narrowing can be evaluated by the Sharp score as well. The anti-VEGF binding antibodies disclosed herein can be used to prevent the joint damage as well as reduce disease signs and symptoms of the disorder.

The antibody is administered by any suitable means, including parenteral, subcutaneous, intraperitoneal, intrapulmonary, and intranasal, and, if desired for local immunosuppressive treatment, intralesional administration. Parenteral infusions include intramuscular, intravenous, intraarterial, intraperitoneal, or subcutaneous administration. In addition, the antibody is suitably administered by pulse infusion, particularly with declining doses of the antibody. Preferably the dosing is given by injections, most preferably intravenous or subcutaneous injections, depending in part on whether the administration is brief or chronic.

For the prevention or treatment of disease, the appropriate dosage of antibody will depend on the type of disease to be treated, the severity and course of the disease, whether the antibody is administered for preventive or therapeutic purposes, previous therapy, the patient's clinical history and response to the antibody, and the discretion of the attending physician. The antibody is suitably administered to the patient at one time or over a series of treatments.

Depending on the type and severity of the disease, about 1 μg/kg to 15 mg/kg (e.g., 0.1-20 mg/kg) of antibody is an initial candidate dosage for administration to the patient, whether, for example, by one or more separate administrations, or by continuous infusion. A typical daily dosage might range from about 1 μg/kg to 100 mg/kg or more, depending on the factors mentioned above. For repeated administrations over several days or longer, depending on the condition, the treatment is sustained until a desired suppression of disease symptoms occurs. However, other dosage regimens may be useful. The progress of this therapy is easily monitored by conventional techniques and assays. An exemplary dosing regimen for an anti-LFA-1 or anti-ICAM-1 antibody is disclosed in WO 94/04188. Exemplary dosing regimens and therapeutic combinations for treating cancer can be found in U.S. Provisional Application No. 60/474,480, filed May 30, 2003.

The antibody composition will be formulated, dosed, and administered in a fashion consistent with good medical practice. Factors for consideration in this context include the particular disorder being treated, the particular mammal being treated, the clinical condition of the individual patient, the cause of the disorder, the site of delivery of the agent, the method of administration, the scheduling of administration, and other factors known to medical practitioners. The "therapeutically effective amount" of the antibody to be administered will be governed by such considerations, and is the minimum amount necessary to prevent, ameliorate, or treat a disease or disorder. The antibody need not be, but is optionally formulated with one or more agents currently used to prevent or treat the disorder in question. The effective amount of such other agents depends on the amount of antibody present in the formulation, the type of disorder or treatment, and other factors discussed above. These are generally used in the same dosages and with administration routes as used hereinbefore or about from 1 to 99% of the heretofore employed dosages. Generally, alleviation or treatment of a disease or disorder involves the lessening of one or more symptoms or medical problems associated with the disease or disorder. In the case of cancer, the therapeutically effective amount of the drug can accomplish one or a combination of the following: reduce the number of cancer cells; reduce the tumor size; inhibit (i.e., to decrease to some extent and/or stop) cancer cell infiltration into peripheral organs; inhibit tumor metastasis; inhibit, to some extent, tumor growth; and/or relieve to some extent one or more of the symptoms associated with the cancer. To the extent the drug may prevent growth and/or kill existing cancer cells, it may be cytostatic and/or cytotoxic. In some embodiments, a composition of this invention can be used to prevent the onset or reoccurrence of the disease or disorder in a subject or mammal.

G. Articles of Manufacture

In another embodiment of the invention, an article of manufacture containing materials useful for the treatment of the disorders described above is provided. The article of manufacture comprises a container and a label. Suitable containers include, for example, bottles, vials, syringes, and test tubes. The containers may be formed from a variety of materials such as glass or plastic. The container holds a composition which is effective for treating the condition and may have a sterile access port (for example the container may be an intravenous solution bag or a vial having a stopper pierceable by a hypodermic injection needle). The active agent in the composition is the antibody. The label on, or associated with, the container indicates that the composition is used for treating the condition of choice. The article of manufacture may further comprise a second container comprising a pharmaceutically-acceptable buffer, such as phosphate-buffered saline, Ringer's solution and dextrose solution. It may further include other materials desirable from a commercial and user standpoint, including other buffers, diluents, filters, needles, syringes, and package inserts with instructions for use.

Incorporated by reference in their entirety are United States Provisional Applications from which this application claims benefit: U.S. Ser. No. 60/491,877, filed Aug. 1, 2003; U.S. Ser. No. 60/516,495, filed Nov. 1, 2003; U.S. Ser. No. 60/570,912, filed May 12, 2004; U.S. Ser. No. 60/571,239, filed May 13, 2004; U.S. Ser. No. 60/576,315, filed Jun. 1, 2004; and U.S. Ser. No. 60/580,757, filed Jun. 18, 2004.

The following examples are intended merely to illustrate the practice of the present invention and are not provided by way of limitation. The disclosures of all patent and scientific literatures cited herein are expressly incorporated in their entirety by reference.

EXAMPLES

Generation of the Synthetic Antibody Phage Libraries

In general, two types of combinatorial antibody libraries have been developed, distinguished by the source of repertoires. Most libraries to date are "natural" antibody libraries which used the natural repertoires as the source for its diversity, where the genes as message RNA of immune cells from naïve or immunized animals or human were amplified and cloned into vector for phage display or other display technology, such as ribosome or yeast display. The natural antibodies usually have multiple frameworks, which together with variable CDRs sequences and the recombination of light chain and heavy chain made up the diversity of the library. The size of the library determined the performance of the libraries since the repertoires were in general larger than the library size (marks et al). The synthetic library, on the other hand, is a new branch of library where the diversity is designed and built into the library with synthetic DNA. Single or multiple frameworks have been used. For single framework library, the source of the diversity solely depends on the degeneracy of synthetic DNA designed to create the diverse CDR loops. Both the diversity design and the size of the libraries are critical for the library performance, which can be measured by the affinity of the antibodies found from the libraries.

We developed a strategy of building synthetic antibody phage library upon the template of a single framework. Residues were selected from CDR loops that are either solvent exposed or highly variable in natural antibodies repertoires according to Kabat database and were randomized by mimicking the natural diversity using tailored codons. We also explored restricting the randomization to heavy chain, which often contribute to the main binding interaction with antigen among natural antibodies, and found it was sufficient to find binders to naïve targets. One of the reasons to restrict the diversity is so that the gap between the DNA degeneracy and practical phage library size is not overwhelmingly large and the sequence space will be covered at sufficient density.

The first library was built on humanized 4D5 framework with a randomized heavy chain and fixed light chain in the format of single chain Fv (ScFv). To the target antigen murine VEGF (mVEGF), many unique binders were found.

Figure 1:
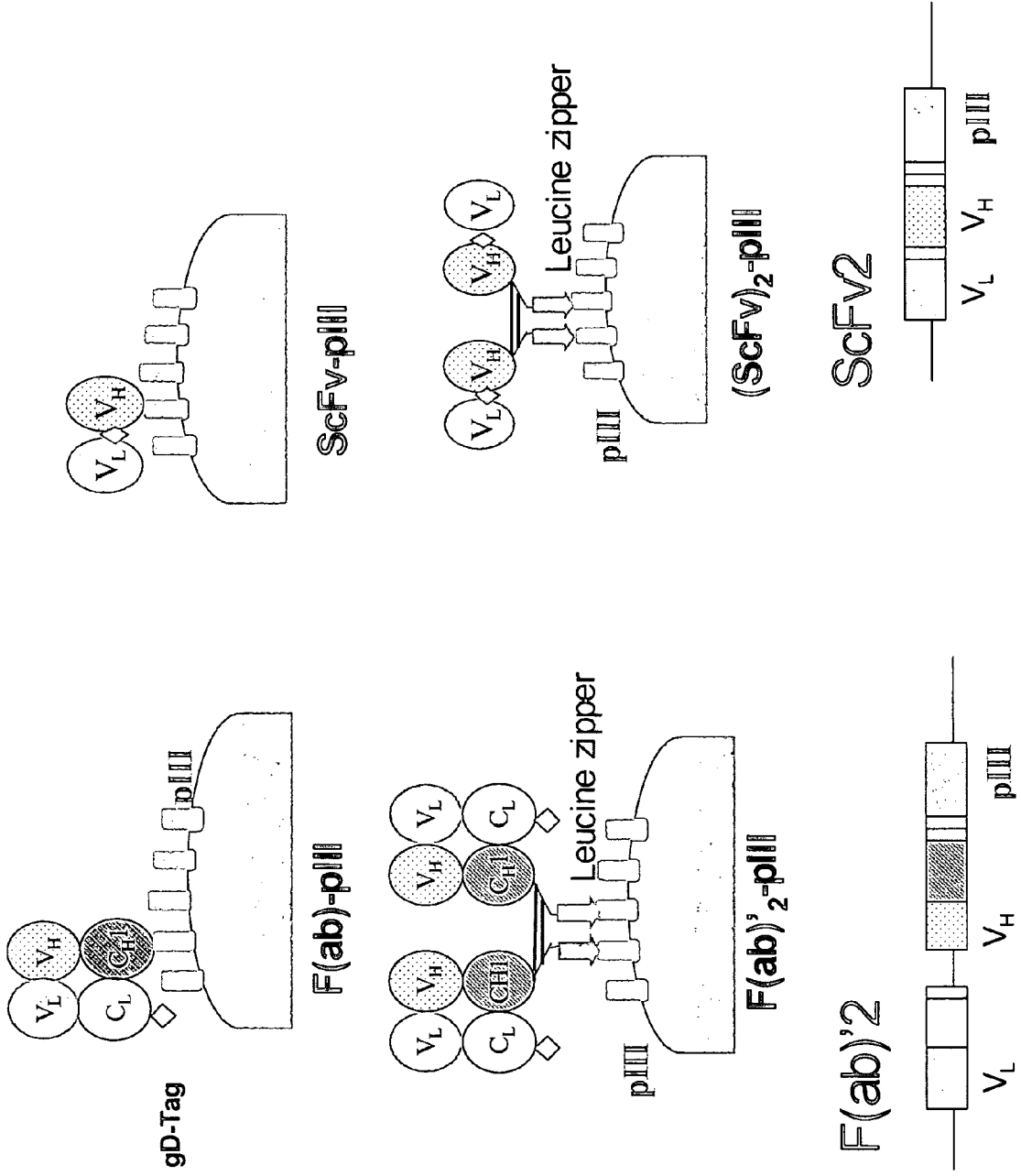
FIG. 1 is a schematic illustration of various types of antibody fragments useful for phage display.

The libraries were then generally further improved by fine-tuning the diversity of CDR-H1 and H2 or the light chain to closely mimic the natural diversity, and by exploring the diversity design of CDR-H3 in the Fab format of display. See FIG. 1 for illustrations of different types of antibody libraries. We found libraries with different designs of CDR-H3 of similar size resulted in binders of hVEGF and mVEGF with sub-nM affinity. The affinity of these binders can be further improved to pM range by a second step of randomizing their light chain CDRs.

For details of strategies and methods for generating synthetic antibody libraries with single template, see, for example, U.S. provisional application U.S. Ser. No. 60/385,338 (filed Jun. 3, 2002), the entire disclosure of which is expressly incorporated herein by reference. Thus, novel antibodies with high affinity to both human VEGF and mouse VEGF could be found in diverse synthetic antibody phage libraries based on a single framework template.

Example 1

G6 and B20 Derived Antibodies (a) Selection of High Affinity Anti-VEGF Fab Clones The selection procedures for high affinity anti-VEGF Fab clones consisted of various combinations of solid-supported and solution-binding sortings. In solid-supported sortings, the antibody phage library was panned with target antigen coated on NUNC 96-well Maxisorp immunoplate at concentration of 5 ug/ml. In solution-binding sorting method, phage library was incubated with decreasing concentration of biotinylated antigen in solution, which then was captured by neutravidin coated on the 96-well Maxisorp plate (2~5 μg/ml). Decreasing concentration allowed more stringency in panning to fish for tighter binders. To the target antigen mVEGF, a two-step sorting strategy was developed such that, in step 1, potent binders were isolated from naïve libraries by means of the solid-supported selection, and subsequently in step 2, those stronger affinity binders could be isolated from weaker ones by the progressive solution-binding method with decreasing target antigen concentration. To quickly screen out these binders, the high throughput single-spot competition binding ELISA was used. Low amount of mVEGF (25 nM) was applied in this assay to screen 16 clones from each library after the $3^{rd}$ round sorting.

As the result of combining solid-supported and solution-binding sortings, three Fab clones, G6, B29, and C3, all from NNK library, were identified as high affinity binders. And after the $5^{th}$ round sorting, the whole library was dominated by G6 clone. Interestingly, B20, which came from NVT library, was found by solution-binding sorting alone. This suggested that more clones can be found by different strategies of sorting methods, which may bias for different clones. With different library designs, more VEGF binding clones with distinct sequences should be identified also. The four unique clones with distinct sequences were first characterized for their binding affinity to murine and human VEGF using competition-binding ELISA at 25° C. IC50 data from phage binding assays represent an estimation of their affinities, and G6 was identified as the highest affinity binder with IC50 at 0.5-1 nM for both human and murine VEGF (FIG. 2).

(b) Activities and Properties

A series of in vitro assays were conducted to examine properties and activities of the selected novel anti-VEGF antibodies.

Epitope Blocking Assay

First, the antibody phage clones were examined for their possible binding epitopes on VEGF. A phage-blocking assay was used, wherein the bindings of the phage clones (at constant concentration) to mVEGF-coated wells were measured in the presence of either a full extracellular domain (ECD) of KDR or a second domain of Flt-1 (Flt-$1_{D2}$), both at increasing concentrations, respectively. Full ECD of KDR or Flt-1 has seven immunoglobulin-like domains, and binds VEGF through the second and third domain. The second domain of Flt-1 alone can bind VEGF at Kd of 2 nM with known epitopes on VEGF, based on the published crystal structure the VEGF-VEGFR complex (Wiesmann et al. (1997) *Cell* 91:695-704). The Kd of KDR ECD binding to VEGF is about 5 nM. We expected that the bindings of the phage clones to be reduced with the increasing addition of receptors, if the epitopes for an antibody on phage overlap significantly with receptor.

For receptor blocking assay at protein level with purified Fab expressed from *E. coli*, (mouse or human VEGF), VEGF receptor immobilized plate by coating baculovirus expressed Flt-1 ECD fragment (Ig domain1-5) (Flt-$1_{D1-5}$) directly, or 293 cell-expressed KDR-Ig fusion, which present KDR ECD (Ig domain 1-7) as Fcγ fusion captured with goat anti-human IgG Fcγ (Jackson ImmunoResearch Lab. West Grove, Pa.) coated on the 96-well Maxisorp immunoplate and blocked with 0.5% BSA and 0.02% Tween20. Biotinylated bacterially expressed hVEGF or mVEGF at 0.2 nM was first incubated with three-fold serial diluted anti-VEGF Fabs, G6, Fab-12 (the Fab of the Avastin™ antibody), or Y0317 in PBS with 0.05% Tween 20 (PBST). After 1 h incubation at room temperature, the mixtures were transferred to a VEGF receptor immobilized plate and incubated for 10 min. The VEGF-A that was not blocked by anti-VEGF was captured with VEGF receptor coated wells and detected by streptavidin-HRP conjugate and developed with TMB substrate as described above.

Figure 3A:
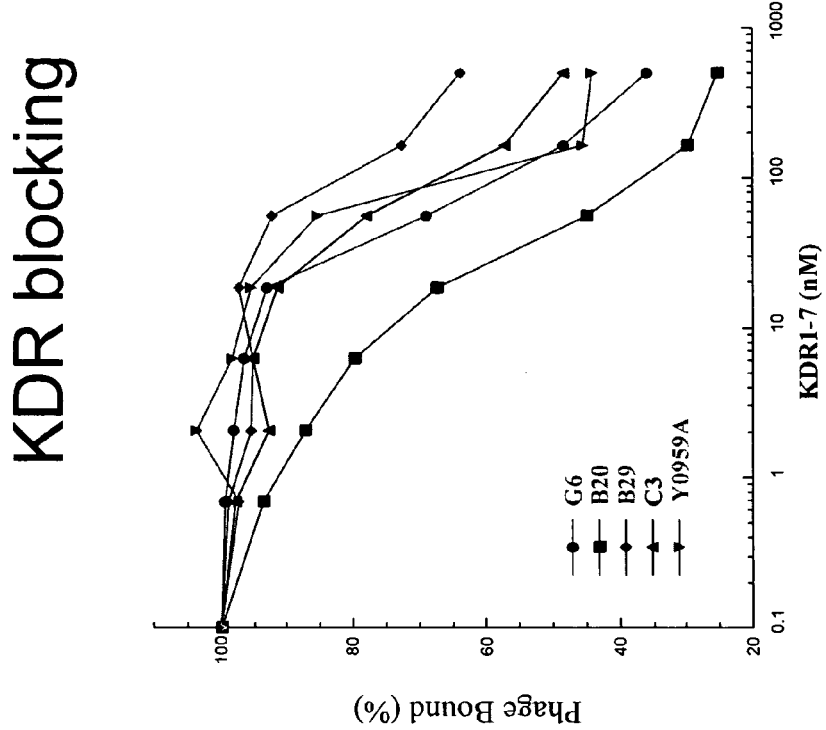
FIG. 3 depicts the abilities of VEGF receptors (Flt1-d2 and KDR) to block VEGF bindings of the novel anti-VEGF antibodies. Y0959A, an anti-VEGF variant, was used as control.
Figure 3B:
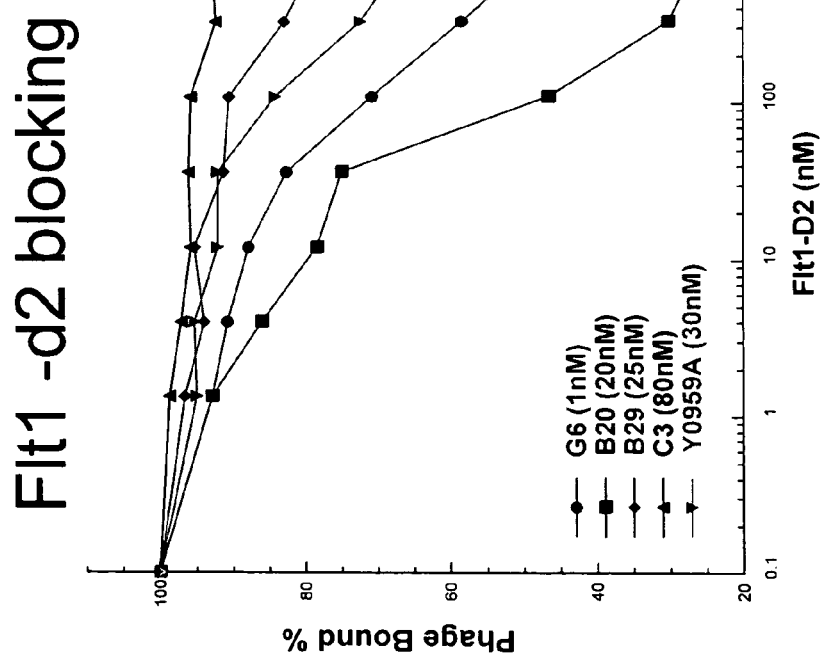

As shown in FIG. 3, the four clones were blocked to different extents by Flt-$1_{D2}$ and KDR. The results of the blocking assay suggested that these four clones might have different binding epitopes on VEGF that are nonetheless overlapped with receptor binding epitope. The affinities of the antibody clones did not correlate with the efficiency of blocking by receptor in this blocking assay. Y0959, a phage clone with known epitope was used as a control. Among the four novel clones, G6 and B20 appeared to have epitopes that sufficiently overlapped with those for both Flt-1 and KDR, since their bindings to mVEGF was significantly reduced in the presence of the receptor fragments. The difference in the blocking efficient is small but has been consistent with multiple assays. One prediction is that G6 or B20 has epitopes that matches with those of receptor on VEGF much better than Fab-12 or its variants, Y0317 and Y0959 (Muller, Y. A., et al., (1998) *Structure* 6:1153-1167). Therefore, we proceeded to generate Fab protein to confirm the binding and examine the epitope. G6 was chosen first for further study since it has the highest affinity against both mVEGF and hVEGF.

Binding Specificity and Neutralizing Activity

Figure 4:
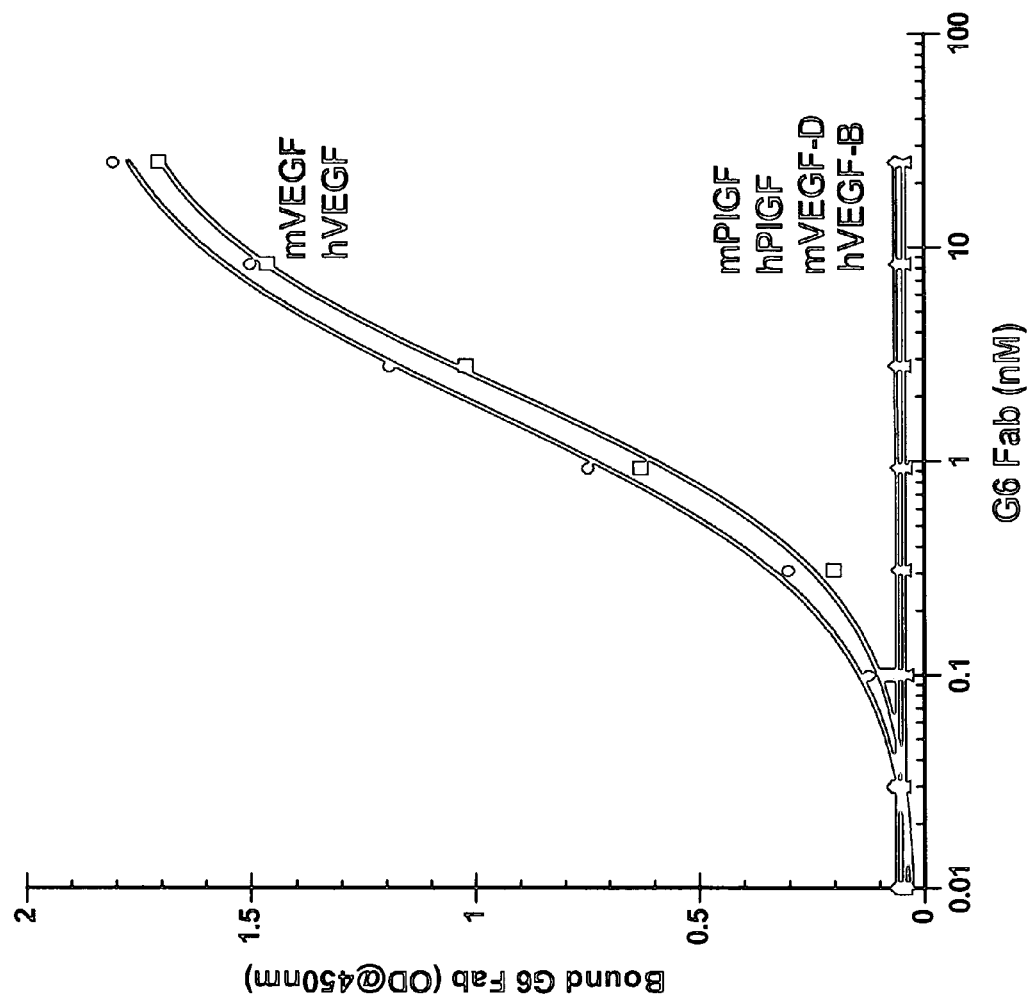
FIG. 4 shows that the G6 antibody specifically binds to both hVEGF and mVEGF, but not to VEGF-related antigens.

To determine the binding specificity of G6 Fab clone, ELSA assays were conducted using human, mouse, rat and rabbit VEGF-$A_{165}$ as well as VEGF homologs including mouse and human placenta growth factor (PlGF-2), mVEGF-D and human VEGF-B. Human and murine placental growth factor (PlGF-2), murine VEGF-D, rat VEGF-A and human VEGF-B were from R&D system. The tested antigens were coated on NUNC 96-well Maxisorp immunoplate at the concentration of 2 ug/ml. Binding with increasing concentrations of G6 Fab protein was measured by Protein G-horse radish peroxidase conjugate and substrate. For example, Fab protein was prepared from *E. coli* harboring the plasmid of G6 Fab expression construct under the promoter of alkaline phosphatase and secretion leader sequences stII and purified with Protein G affinity column. G6 Fab binding to VEGF and its homologs were measured by direct ELISA. VEGF homolog-coated wells (at 2 ug/ml in PBS concentration) were blocked with 0.5% BSA and 0.05% Tween20 at 25° C. Fab at increasing concentrations were incubated with the VEGF homolog-coated wells for 1 h at 25° C. and measured with anti-human Fab antibody horse radish peroxidase conjugate diluted in PBT buffer, then developed with TMB substrate. Solution binding assays were also carried out for some proteins by incubating 0.5 nM of G6 Fab with increasing concentrations of a VEGF homolog for 1-2 h at 25° C., and the unbound Fab was captured with mVEGF-A coated wells and measured. As shown in FIG. 4, the G6 Fab protein binds equally well to both mVEGF and hVEGF (approximately 0.6 nM and 1.4 nM, respectively). Moreover, the G6 antibody did not bind to other VEGF homologs at all, and thus is highly specific to VEGF. The G6 Fab bound rat and rabbit VEGF with similar affinity as for mVEGF (data not shown).

Figure 5A:
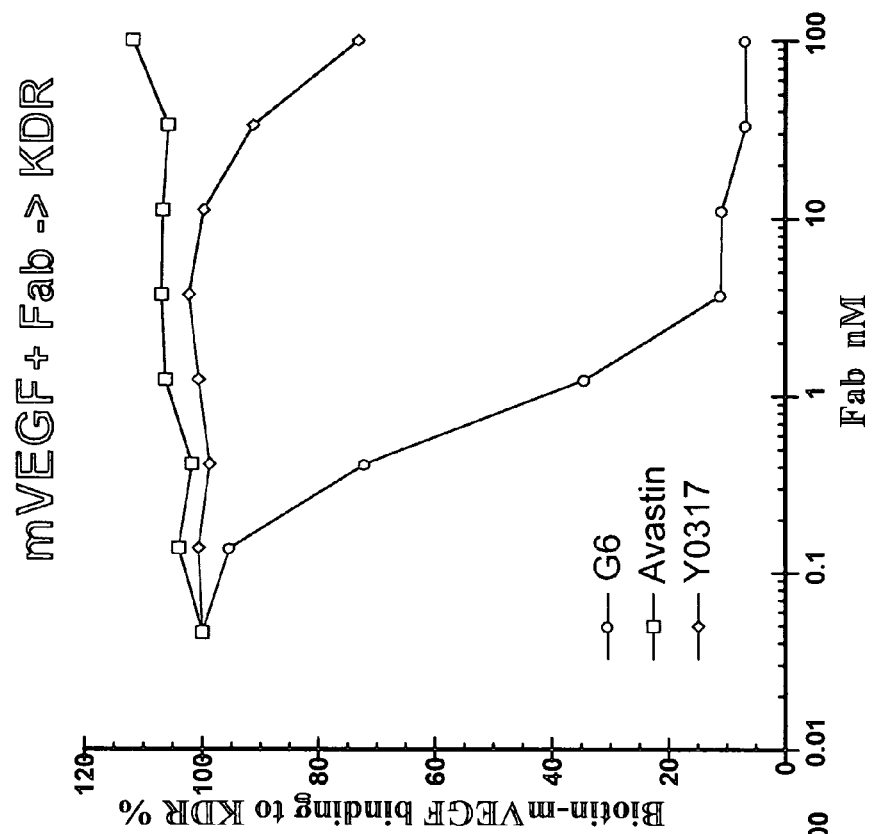
FIG. 5 shows that G6 can effectively block both hVEGF and mVEGF binding to the KDR receptor. Fab-12 and Y0317 were used as controls.
Figure 5B:
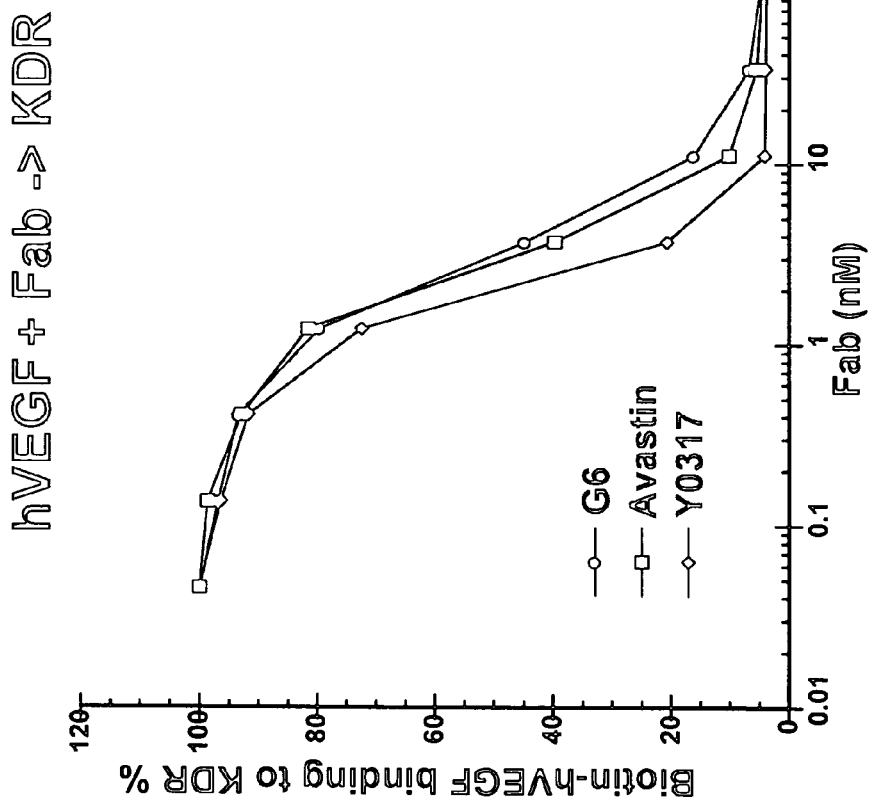

To test if G6 not only binds to VEGF at high affinity, but also is capable of effectively blocking VEGF's binding to VEGF receptors, blocking assays were conducted, wherein either hVEGF or mVEGF was tested for its binding to KDR in the presence of increasing concentrations of the G6 Fab clone. Also used as control were the two anti-hVEGF antibodies, Fab-12 (the Fab of Avastin™) and Y0317, that are capable of effectively blocking hVEGF but neither bind to mVEGF nor block its activities. As shown in FIG. 5, G6 effectively blocked hVEGF's binding to KDR with an efficacy similar to that of Fab-12 or Y0317. Furthermore, G6 can also significantly block mVEGF's binding to KDR. In comparison, neither Fab-12 nor Y0317 showed any blocking effect on mVEGF.

Thus, the novel anti-VEGF antibody G6 of this invention is a high affinity anti-VEGF antibody capable of binding and blocking VEGF from both human and murine species.

Cell-Based Assay

To further determine binding specificity and blocking activities of the novel antibody G6, a cell-based assay using human umbilical vein endothelial cells (HUVECs) was conducted, wherein various anti-VEGF antibodies were tested for their abilities to block either human or murine VEGF induced cell proliferation. Basically, 96-well tissue culture plates were seeded with 3000 HuVECs per well and fasted in the assay medium (F12:DMEM 50:50 supplemented with 1.5% (v/v) diafiltered fetal bovine serum) for 24 hours. The concentration of VEGF used for stimulating the growth of cells was determined by first titrating to identify the amount of VEGF that can induce 90% of maximal DNA synthesis. Fresh assay medium with fixed amounts of VEGF (0.1 nM final concentration) and increasing concentrations of anti-VEGF Fab were then added. After 24 hours of incubation, cells were pulsed with 0.5 µCi per well of [$^3$H] thymidine for 24 hours, and then harvested on to 96-well filter plate for counting by a TopCount gamma counter. Here the DNA synthesis was measured by incorporation of tritiated thymidine. In this assay, the anti-VEGF antibodies serving as the control were Fab-12 and Y0317.

As shown in FIG. 6, G6 antibody significantly reduced both hVEGF and mVEGF's abilities to promote HUVEC proliferation. The basic fibroblast growth factor (bFGF) experiment here served as a control to demonstrate that none of the anti-VEGF Fabs used in this assay had any non-specific toxicity to the host cells.

(c) Affinity Improvement of the G6 and B20 Anti-VEGF Antibodies

Two novel antibody clones, G6 and B20, were chosen for further improvement on binding affinities. To improve affinity, several selected residues of the light chain CDR were randomized, since both clones came from a library with only randomized heavy chain and a fixed light chain. Surface exposed CDR residues and residues that are highly diverse in the Kabat database of natural antibody sequences were chosen. Site-directed mutagenesis was used with tailored degenerate codons to generate amino acid diversity that mimicked the natural immune repertoire at each CDR site on light chain (FIG. 7). Sorting was first performed by adding the library on immobilized hVEGF or mVEGF on the Maxisorp 96-well plate to maximize the recovery of binders, followed by solution sorting with decreasing concentration of biotinylated hVEGF or mVEGF as two separate tracks of selection. Concentration of biotinylated VEGF was selected based on the initial affinity of the clone to gauge the pressure of the sorting. The selection pressure was also increased by incubating phage binders with 1000 fold excess of un-biotinylated antigen in solution for different length of time at different temperature after initial incubation of the phage library with biotinylated VEGF and before capturing by neutravidin coated on 96-well Maxisorp plate.

As an example of the above-described processes, G6 having 1 nM affinity was subject to further affinity improvement. The first round of sorting used solid-supported method to capture all clones that still bound VEGF, and then at the second round of sorting, the phage library was incubated with 1 nM of VEGF. Next, the solution-binding used 1 nM biotinylated hVEGF to select most binders. Before capturing, 1 uM unbiotinylated hVEGF was added and incubated at RT for 15 min to compete off fast off-rate binders. Then in the following rounds of sorting ($3^{rd}$ and $4^{th}$), more selection pressure was put into solution sorting by using less biotinylated hVEGF (0.1 nM) to select and 100 nM unbiotinylated hVEGF at 37 C. for 30 min or longer time (2 hr or 6 hr) to compete off high off-rate binders and fish for low off-rate binders.

The same strategy was utilized to improve B20 clone, except that less stringent condition was used because of its low affinity against hVEGF (IC50~150 nM). The mVEGF selection track followed the same procedures and conditions as what were used with hVEGF. Enrichment was calculated by the eluted phage titers ratio to selection without biotinylated target. After sorting, high throughput single-spot competition binding ELISA as described above was used to quickly screen for improved affinity clones.

In this assay, low amount of hVEGF or mVEGF (10 nM) was applied to screen 51 clones from G6-based phage library and 110 clones from B20-based phage library with the control of wild type G6 and B20 binders. Several improved G6 clones, collectively termed G6-II variants, were selected out and showed remarkably increased binding affinity to both human and murine VEGF by over one hundred fold by comparing the phage IC50 values with wild-type clones (FIG. 7). Clones with many unique sequences were found that have improved affinity, which suggested that there are many light chains that can accommodate the heavy chain of the selected clones. It is also interesting to note that binding specificities of some clones were changed. This suggests that light chain is able to modulate the interaction of heavy chain with its antigen sufficiently to alter its specificities. As for the clone sequences, most G6-II clones were different from G6 only in their third light chain CDR (CDR-L3).

To generate Fab protein or IgG protein for affinity and activity assays, we cloned the variable region into a Fab expression plasmid for expression in an *E. coli* or a mammalian cell (a phagemid vector that had been modified by deleting the sequence encoding the C-terminal domain of phage coat protein p3 and adding a termination sequence for ribosome binding about 20 nucleotides downstream from the stop codon at the end of heavy chain first constant domain). Fab protein was generated by growing transformed 34B8 *E. coli* cells in AP5 media at 30° C. for 24 h as described (Presta, L et al., (1997) *Cancer Res* 57:4593-4599). IgG was purified with Protein A columns and Fab was purified with Protein G affinity chromatography. The production yield for Fab was typically 5-10 mg/L in small scale shake flask growth and 0.5-3 g/L in fermenter growth. IgG production was reasonably high at 10-50 mg/L small scale culture with some clone to clone differences.

Three G6-II improved clones, G6-8, G6-23 and G6-31 (see FIG. 7 for residue changes in light chain CDRs), were selected to make into Fab protein for affinity measurement, epitope mapping by receptor blocking assay, and activity study in HuVEC growth inhibition assay. For affinity determinations of anti-mVEGF Fabs, we used surface plasmon resonance assays on a BIAcore™-2000 or a BIAcore™-3000 (BIAcore, Inc., Piscataway, N.J.) at 25° C. and 37° C. with immobilized mVEGF or hVEGF CM5 chips at 100 response units (RU) as described (Chen, Y., et al., (1999) *J. Mol Biol* 293:865-881). Briefly, carboxymethylated dextran biosensor chips (CM5, BIAcore Inc.) were activated with N-ethyl-N'-(3-dimethylaminopropyl)-carbodiimide hydrochloride (EDC) and N-hydroxysuccinimide (NHS) according to the supplier's instructions. Human or murine VEGF was diluted with 10 mM sodium acetate, pH 4.8, into 5 ug/ml (~0.2 uM) before injected at a flow rate of 5 ul/minute to achieve approximately 100 response units (RU) of coupled protein. Following the injection of 1M ethanolamine to block unreacted groups. For kinetics measurements, two-fold serial dilutions of Fab (100 to 0.78 nM or 3 nM to 500 nM) were injected in PBS with 0.05% Tween 20 (PBST) at 25° C. at a flow rate of approximately 25 ul/min. Association rates ($k_{on}$) and dissociation rates ($k_{off}$) were calculated using a simple one-to-one Langmuir binding model (BIAcore Evaluation Software version 3.2) by simultaneous fitting the association and dissociation sensorgram. The equilibrium dissociation constant (Kd) was calculated as the ratio $k_{off}/k_{on}$.

Since the $k_{on}$, of affinity improved G6 variants did not result in satisfactory statistics with the available binding model in BIAcore evaluation methods, solution competition binding assays using phage-displayed proteins were also carried out to measure the relative affinity of those antibodies at equilibrium. VEGF displayed on phage were incubated with serial dilutions of Fab at room temperature for 20 h to reach equilibrium and the unbound VEGF-phage were captured with G6 Fab briefly (10 min) and measured with anti-M13-HRP and substrate TMB as above. A second format of solution competition binding assay was also carried out where Fab was displayed on phage and interact with dilutions of VEGF to reach equilibrium (20 h) and unbound Fab were captured on VEGF coated 96-well plate and measured as above. The two IC50s values were averaged to get binding affinities as final IC50s. Binding of Fabs to mVEGF were assayed only with second format due to the lack of the reagent of mVEGF displaying phage.

From initial SPR experiments, it was noted that there was significant $k_{on}$, improvement. For example, we found that G6-23 had the most significant improvement in on-rate at 25° C. and 37° C. against both human and murine VEGF, and small reduction in off-rate (FIG. 8). The $k_{on}$ for G6-31 improved as compared to G6 as well (data not shown). Further, the solution competition binding assays confirmed that G6-23 was the most affinity-improved clone with its high affinity of IC50 of 20 pM against hVEGF and mVEGF (FIG. 7).

Fluorescent quenching assays were also performed to determine the $k_{on}$, rates of the higher affinity G6 series antibodies. Therefore, three of the affinity matured Fabs (G6-8, G6-23 and G6-31) were purified as Fab proteins, and their affinities for mVEGF were compared to G6 by using and fluorescence quenching in solution for the rate of association (on rate, $k_{on}$) (Table 1 and FIGS. 30A and B).

TABLE 1

| | Affinity | | |
|---|---|---|---|
| Clone | $k_{on}$ ($10^5$ $M^{-1}$ $S^{-1}$) | $k_{off}$ ($10^{-4}$ $S^{-1}$) | Kd (nM) |
| G6 | 1.75 (1.93) | 1.6 | 0.91 |
| G6-23 | 56.6 | 1.21 | 0.021 |
| G6-31 | 21.6 | 0.35 | 0.016 |
| G6-8 | 16.8 | 1.29 | 0.077 |

The fluorescence quenching assays were performed as follows. The change of fluorescence intensity in complexing the Fab and VEGF was used to determine the rate of association as developed for the on-rate determination of Fab-12 variants and VEGF (Marvin J. S. and H. B. Loman (2003) *Biochemistry* 42:7077-7083). We first determined that the fluorescence intensity with an excitation wavelength of 280 nm of G6 (or variants)-VEGF complex was lower than the sum of individual components using an 8000-series SLM-Aminco spectrophometer (Thermo-Spectronic) by adding 100 nM VEGF to a stirred cuvette containing 20 nM Fab in PBS, pH 7.2, at 25° C. Next, increasing concentrations of VEGF (100-400 nM) was mixed with equal volumes of 40 nM Fab in a stop-flow (Aviv Instruments) equipped spectrophometer to observe the rate of the decrease of fluorescence intensity at 25 C. For each experiment, nine measurements were performed for each concentration and fitted to a single-exponential curve. The observed rate was then plotted against VEGF concentrations for pseudo-first order analysis, and the slope is the rate of association. Two to three independent experiments were carried out and the differences were within 50%.

The estimated $k_{on}$ of the improved clones from the SPR method were ~3-6-fold lower than the measurements by solution-based fluorescence quenching assay, whereas $k_{on}$ measurements for parent G6 Fab from SPR was statistically sound and within 1.2-fold difference with fluorescence quenching assays. It is possible that using BIAcore SPR technology for fast on-rate measurements was limited by the complex flow dynamics, or there could be some differences in protein behaviors between the parent clone and affinity-improved clones, though aggregation problems were not observed with these proteins. Based on the fluorescence assays, the three Fabs exhibited improvements over G6 in the on-rate by 6, 8 or 20-fold for G6-8, G6-31 or G6-23, respectively. Fab-G6-31 also exhibited an ~4-fold improvement in the off-rate, and as a result, the affinity of Fab-G6-31 ($K_d$=16 pM) and Fab-G6-23 ($K_d$=21 pM) was ~40-60-fold improved compared to the G6 parent ($K_d$=910 pM). It was consistent with the solution phase competition assays, which showed a 20-60-fold improvement in IC$_{50}$ value for G6-31 (30 pM) or G6-23 (10 pM) in comparison with G6 (0.67 nM). We applied the light chain affinity maturation strategy to five other heavy chain sequences and have observed 10- to 30-fold improvements in binding affinities (data not shown). Unlike G6, many improved clones adopted new sequences for all three light chain CDRs. Thus, we found that the three G6 variants increased binding affinity to both human and murine VEGF over G6, predominantly by the increase in the rate of association (on rate or k$_{on}$). G6-23 had the highest on rate and then followed by G6-8 and then G6-31. The improvement in the rate of dissociation (off rate or k$_{off}$) was 2-3 fold for G6-23, and 8 or 13-fold for G6-31 for hVEGF or mVEGF, respectively. Compared to Fab-12 and Y0317, G6 and G6-23 had significantly different binding kinetics (FIG. 32). G6-23 had similar Kd as Y0317 but a faster kinetics with fast on rate of over 10$^6$ (M$^{-1}$s$^{-1}$), and moderate rate of dissociation (off rate or k$_{off}$) at 1-2×10$^{-4}$s$^{-1}$, whereas Y0317 has slow k$_{on}$ at 3×10$^4$ M$^{-1}$s$^{-1}$, and very slow k$_{off}$ at ~5×10$^{-6}$s$^{-1}$ (FIG. 32).

The solution competition binding assay used biotinylated protein antigens equilibrated with serial dilutions of purified Fab or IgG proteins, and the unbound biotin-antigen was captured with immobilized Fab or IgG coated on Maxisorb plates and was detected with streptavidin conjugated HRP. Alternatively Fab or IgG proteins were equilibrated with serial dilutions of protein antigen, and the unbound Fab or IgG was captured with immobilized antigen and detected with protein A-HRP.

For the VEGF receptor blocking assay using purified Fab, VEGF receptor was immobilized on a plate by coating Flt-1 ECD fragment (Ig domain1-5) (Flt-1$_{D1-5}$) directly, or by first coating with goat anti-human IgG Fcγ (Jackson ImmunoResearch Lab. West Grove, Pa.) and then treating with KDR-IgG fusion receptor which presented KDR ECD (Ig domain 1-7) as a dimer, on a 96-well Maxisorp immunoplate. The plate was then blocked with 0.5% BSA and 0.02% Tween20. Subnanomolar concentrations of biotinylated hVEGF or mVEGF at 0.2 nM were incubated with three-fold serial diluted anti-VEGF Fabs, G6, G6-II (G6-8, 23, and 31), Fab-12, or Y0317 in PBST. After 1 h incubation at room temperature, the mixtures were transferred to the plate containing immobilized VEGF receptor and incubated for 10 min. The VEGF-A that was not blocked by anti-VEGF was captured with VEGF receptor coated wells and detected by streptavidin-HRP conjugate and developed with TMB substrate as described above. The results showed that, compared to the original G6, the selected G6-II Fabs indeed have increased blocking activities for both hVEGF and mVEGF. Strong blocking had been observed with both G6 and B20 phage display clones which suggested that their binding epitopes on VEGF overlapped with the epitopes for receptors. G6 Fab was also shown to block the binding of both human and murine VEGF to Flt-1 ECD (FIG. 31) efficiently. In comparison, Fab-12 can only block hVEGF but not mVEGF binding to receptor, consistent with binding specificities. An Fab-12 variant with improved affinity for hVEGF (Kd=20 pM), Y0317, inadvertently acquired some weak affinity to mVEGF (Kd~300 nM at 25 C, Y. Chen and H. Lowman unpublished results) and show a slight receptor blocking activity to mVEGF at high concentrations.

Inhibition of VEGF activity in the endothelial cell growth assay (HuVEC) was performed as described above. Like G6, G6-II specifically inhibited the growth of human umbilical vein endothelial cell stimulated by human and murine VEGF, but not the growth stimulated by human basic fibroblast growth factor (bFGF). The concentration required to inhibit 50% of the growth of the cells stimulated by both human and murine VEGF (HUVEC IC50) correlated well with the affinity measured by BIAcore or solution binding ELISA assay at 37° C. Compared with G6, G6-23 and G6-31 showed at least 100 fold improvement in inhibiting HuVECs growth stimulated by hVEGF or mVEGF. Fab-12 and Y0317 Fabs were also measured in the same assays to serve as controls. Fab-12 showed no measurable binding to mVEGF, whereas Y0317 Fab could bind mVEGF at 350 nM affinity. Therefore, as expected, Y0317 and Fab-12 did not show any inhibitory effects on mVEGF mediated HUVEC growth. We showed that many G6-II variants with different light chain can have improved affinity and the solution-binding assay can also predict the outcome of the potency as inhibitor in HuVEC cell assay.

VEGF bindings of G6-23 were compared with that of G6 as well as Fab-12. As shown in FIG. 8. G6-23 has significantly improved on-rate for binding to both hVEGF and mVEGF. While the off-rate of G6-23 is substantially similar to that of G6, the overall Kd of G6-23 is at least about 7 fold better than that of G6 for both hVEGF and mVEGF.

Example 2

Mapping of VEGF Binding Sites on G6 and G6-23 Antibodies

Functional Mapping of G6 and G6-23 by Shotgun Alanine and Homolog Scanning

Functional mapping of G6 and G6-23 by shotgun alanine and homolog scanning were performed to identify residues that are important for binding hVEGF and finding residues that can be improved further for binding VEGF. We generated combinatorial phage libraries which allowed heavy chain or light chain CDR residues in separate libraries to be either alanine or wild type (alanine scanning), or either homologous amino acid or wild type (homolog scanning).

Mutagenic Oligonucleotides for Shotgun Scanning Libraries

The following mutagenic oligonucleotides for shotgun alanine (A)- and homolog (H)-scan library constructions to randomize CDR residues in G6 and G6-23 antibodies were designed using previously described shotgun codons (Vajdos et al. (2002) *J. Mol Biol* 320:415-428). Equimolar DNA degeneracies are represented in the IUB code (K=G/T, M=A/C, R=A/G, S=G/C, V=A/C/G, W=A/T, Y=C/T), and the degenerate codons are shown in bold text. All the following oligonucleotides were generated by Genentech DNA synthesis group.

| Oligo | Sequence |
|---|---|
| H1-A | GCA GCT TCT GGC TTC ACC ATT KCC GMT KMT KSG ATA CAC TGG GTG CGT CAG (SEQ ID NO: 3) |
| H2-A | AAG GGC CTG GAA TGG GTT GCA GST ATT RCT CCT GST GST GGT KMT ACT KMT TAT GCC GAT AGC GTC AAG GGC (SEQ ID NO: 4) |
| H3-A | ACT GCC GTC TAT TAT TGT GCA CGC KYT GYT KYT KYT SYT SCA KMT GCT ATG GAC TAC TGG GGT CAA (SEQ ID NO: 5) |
| L1-A | ACC TGC CGT GCC AGT SMA GMT GYT KCC RCT GST GTA GCC TGG TAT CAA CAG AAA C (SEQ ID NO: 6) |

-continued

| Oligo | Sequence |
|---|---|
| L2-A | CCG AAG CTT CTG ATT KMT KCC GCA TCC KYT CTC KMT TCT GGA GTC CCT TCT CGC (SEQ ID NO: 7) |
| L3-A1 | GCA ACT TAT TAC TGT SMA CAA KCC KMT RCT RCT CCT SCA ACG TTC GGA CAG GGT ACC (SEQ ID NO: 8) |
| L3-A2 | GCA ACT TAT TAC TGT RMA CAA GST KMT GST RMC CCT KSG ACG TTC GGA CAG GGT ACC (SEQ ID NO: 9) |
| H1-H | GCA CCT TCT GGC TTC ACC ATT KCC GAM TWC YKG ATA CAC TGG GTG CGT CAG (SEQ ID NO: 10) |
| H2-H | AAG GGC CTG GAA TGG GTT GCA GST RTT ASC SCA KCT GST GST TWC ASC TWC TAT GCC GAT AGC GTC AAG GGC (SEQ ID NO: 11) |
| H3-H | ACT GCC GTC TAT TAT TGT GCA CGC TWC RTT TWC TWC MTC SCA TWC GCT ATG GAC TAC TGG GGT CAA (SEQ ID NO: 12) |
| L1-H | ACC TGC CGT GCC AGT SAA GAM RTT KCC ASC KCT GTA GCC TGG TAT CAA CAG AAA C (SEQ ID NO: 13) |
| L2-H | CCC AAG CTT CTG ATT TWC KCC GCA TCC TWC CTC TWC TCT GGA GTC CCT TCT CGC (SEQ ID NO: 14) |
| L3-H1 | GCA ACT TAT TAC TGT VAR VAR KCC TWC ASC ASC CCT SCA ACG TTC GGA GAG GGT ACC (SEQ ID NO: 15) |
| L3-H2 | GCA ACT TAT TAC TGT VAR VAR GST TWC KCT RAC CCT TKG ACG TTC GGA CAG GGT ACC (SEQ ID NO: 16) |

Phagemid Template Vectors for Shotgun Scanning Library Constructions (A) phagemid pV350-2b Phagemid pV0350-2b, which was previously used to display h4D5 Fab, a humanized antibody against the extracellular domain (ECD) of EGF-related binding receptor 2 (ErbB2), monovalently on the surface of M13 bacteriophage and contained stop codon (TAA) in all three CDR in heavy chain (hc), served as the template for G6 heavy chain shotgun-scan library construction.

More specifically, the phagemid pV0350-2b was derived from the pS0643 phagemid. The phagemid vector, pS0643 (also known as phGHam-g3, e.g., U.S. Pat. No. 5,688,666, Example 8), contains pBR322 and f1 origins of replication, an ampicillin resistant gene, an E. coli alkaline phosphatase (phoA) promoter (Bass et al., (1990) Proteins 8:309-314), and a sequence encoding a stII secretion signal sequence fused to residues 1-191 of human growth hormone (hGH) and a sequence encoding the C-terminal residues 267-421 of protein III of M13 phage (hereinafter, cP3 or pIII). The pS0643 phagemid also contains an XbaI site and an amber stop codon following residue 191 of hGH. The stII secretion signal sequence can export a protein to the periplasm of a bacteria cell (e.g., a light chain region (LC) of an antibody). The sequence encoding the human growth hormone (hGH) was removed from the pS0643 vector and replaced with a NsiI/XbaI nucleic acid fragment encoding a humanized anti-Her2 Fab fragment ("h4D5" sequence) ligated in frame with the stII secretion signal (humAb4D5-8, see Carter et al., (1992) PNAS 89:4285-4289 therein or U.S. Pat. No. 5,821,337, for sequence). The amber stop codon between the heavy chain fragment and cP3 was deleted, as this modification has been shown to increase the levels of Fab displayed on phage.

The h4D5 antibody is a humanized antibody that specifically recognizes a cancer-associated antigen known as Her-2 (erbB2). The h4d5 sequence was obtained by polymerase chain reaction using the humAb4D5 version 8 ("humAb4D5-8") sequence and primers engineered to give rise to a 5' NsiI site and a 3' XbaI site in the PCR product (Carter et al., (1992) PNAS 89:4285-4289). The PCR product was cleaved with NsiI and XbaI and ligated into the pS0643 phagemid vector. The h4D5 nucleic sequence encodes modified CDR regions from a mouse monoclonal antibody specific for Her-2 in a mostly human consensus sequence Fab framework. Specifically, the sequence contains a kappa light chain (LC region) upstream of VH and CH1 domains (HC region). The method of making the anti-Her-2 antibody and the identity of the variable domain sequences are provided in U.S. Pat. Nos. 5,821,337 and 6,054,297. The pS0643 plasmid containing humanized 4D5 (version 8) was still further modified. For example, a herpes simplex virus type 1 glycoprotein D epitope tag (gD tag-MADPNRFRGKDLGG (SEQ ID NO: 17)) was added in frame to the c-terminus of the LC using site-directed mutagenesis. Following the stop codon downstream of the LC, a ribosome binding site and nucleic acid molecule encoding a stII signal sequence were ligated to the N-terminus of the HC sequence. Consequently, the HC sequence is in frame with the C-terminal domain of the p3 (cP3), a minor coat protein of M13 phage. Thus, a Fab displayed on phage can be produced from one construct. This Fab phagemid vector is referred to as pV0350-2b and is be schematically illustrated in FIG. 1. The light gene in pV0350-2b was further modified by mutating a few other amino acid residues, e.g., Arg66 to a Gly and S93 to Ala.

To generate F(ab)'2 displayed on phage, the PV0350-4 vector was further modified by inserting a dimerizable leucine zipper GCN4 sequence (GRMKQLEDKVEELL-SKNYHLENEVARLKKLVGERG) (SEQ ID NO: 18) between the HC and cP3 sequences by cassette mutagenesis. The GCN4 leucine zipper brings two sets of LC/HC-cP3 fusion polypeptides together in the E. coli periplasm and presents the dimer on the surface of phage. This F(ab)'2 phagemid vector is referred to as pV0350-4 is also schematically illustrated in FIG. 1.

For G6-23 heavy chain shotgun-scan library construction, phagemid pW0448-2 was constructed by introducing G6-23 CDRL3 sequence into pV0350-2b phagemid using Kunkel mutagenesis method (Kunkel et al., (1991) Methods Enzymol 204:125-139)). Phagemid pW0448-1 was also generated from pV0350-2b as template for G6 and G6-23 light chain shotgun-scanning library that contains the heavy chain variable domain of G6 and stop codon (TAA) in all three CDRs in light chain.

Construction of Shotgun Scanning Libraries

Phage-displayed libraries were constructed using Kunkel mutagenesis method as described (Kunkel et al., 1991, supra). In total, eight libraries were generated: hcA-G6, hcA-G6.23, 1cA-G6 and 1cA-G6.23 were alanine scanning libraries of heavy chain (hc) or light chain (1c) of G6 and G6-23; hcH-G6, hcH-G6.23, 1cH-G6, 1cH-G6.23 were homolog scanning libraries. The template containing TAA stop codon within all three heavy or light chain CDRs was simultaneously repaired during the mutagenesis reaction by the above mutagenic oligonucleotides with designed degenerate codons. After mutagenesis, 10 ug of DNA were electroporated into E. coli SS320 cells (~10$^{11}$ cells)(Sidhu et al., (2000) *Methods Enzymol* 328:333-363), which were grown overnight at 30° C. in 2YT broth supplemented with M13-KO7 helper phage (New England Biolabs), 50 ug/ml carbenicillin and kanamycin. Library sizes were 2-5×10$^9$. Phage were concentrated from the culture media by precipitation with PEG/NaCl and resuspended in phosphate-buffered saline (PBS) as described previously (Sidhu et al., 2000, supra).

Library Sorting and Screening Assays

Protein target, VEGF or anti-gD tag antibody (provided by Genentech research groups), was immobilized on NUNC (Roskilde, Denmark) 96-well Maxisorp imnunoplates overnight at 4° C., and before sorting, the plates were blocked with bovine serum albumin (BSA, Sigma) for 2 hour at room temperature (RT). Phage libraries from the above preparation (~10$^{13}$ phage/ml) were incubated in the target-coated immunoplates for 1 h at RT to allow for phage binding. Plates were then washed 15 times with PBS and 0.05% Tween 20 (PST) buffer, and bound phage were eluted with 0.1M HCl for 15 minutes and neutralized with 1.0 M Tris base. Eluted phage were propagated in E. coli XL1-blue (Stratagene) for next round of selection.

Individual clones selected from the second round of panning were grown in a 96-well plate overnight at 37° C. with 150 ul of 2YT broth supplemented with 50 ug/ml carbenicillin and M13-VCS helper phage (1:2500)(Stratagene). The culture supernatants were directly used in phage competitive enzyme-linked immuno-absorbent assays (phage ELISAs) to screen functional phage-displayed G6 or G6-23 Fab variants binding to target proteins coated on the plate (Sidhu et al., 2000, supra). The clones exhibited both positive phage ELISA signals to VEGF antigen and anti-gD tag antibody were subjected to DNA sequence analysis.

DNA Sequencing and Analysis

The functional clones from the above screening were grown in 96-well plates with 100 ul of 2YT broth and 50 ug/ml carbenicillin at 37° C. for 2 hour. Little amount of culture supernatants (1~2 ul) was served as templates for PCRs (GeneAmp® PCR System 9700, Applied Biosystems) to amplify the phagemid DNA fragments containing the light and heavy chain genes with sequencing primers to add M13 (−21) universal sequences at the 5' end of the amplified fragments, thus facilitating the use of M13 forward primers in sequencing reactions. Amplified DNA fragments in a 96-well format were sequenced using Big-Dye terminator sequencing reactions and analyzed on an ABI Prism 3700 96-capillary DNA analyzer (PE Biosystems, Foster City, Calif.) by Genentech DNA sequencing group. The sequences were analyzed with the program SGCOUNT as described previously (Weiss et al., (2000) *PNAS USA* 97:8950-8954).

The following number of functional clones in parenthesis selected from each library against VEGF antigen was subjected to DNA sequence analysis: hcA-G6 (107), hcA-G6-23 (124), 1cA-G6 (111), 1cA-G6-23 (102), hcH-G6 (111), hcH-G6-23 (135), 1cH-G6 (106), 1cH-G6-23 (97). For the clones from anti-gD tag antibody binding selection: hcA-G6 (108), hcA-G6-23 (130), 1cA-G6 (116), 1cA-G6-23 (98), hcH-G6 (120), hcH-G6-23 (122), 1cH-G6 (111), 1cH-G6-23 (102).

Fab G6 and G6-23 Point Mutants and Affinity Measurements

To generate G6 and G6-23 Fab mutants for affinity measurements, we used previously modified Fab expression plasmid from phage-displayed vector with an E. coli alkaline phosphatase (phoA) promoter (Presta et al., (1997) *Cancer Res* 57:4593-4599). Each point mutant was constructed using the Kunkel site-directed mutagenesis method (Kunkel et al., 1991, supra) with oligonucleotides designed to have point mutation within CDRs. For mutant productions, expression plasmids were transformed into 34B8 E. coli cells, and single colony was picked and grown in complete C.R.A.P. medium (Presta et al., 1997, supra) supplemented with 25 ug/ml carbenicillin at 30° C. for 24 h. The expressed recombinant proteins were purified through a Protein G high trap column (Amersham Pharmacia) and quantitated by UV absorption at 280 nm (Presta et al., 1997, supra). The binding affinities of G6 and G6-23 Fab mutants were evaluated using competitive solution binding ELISA with hVEGF displaying phage as described. The fold reduction in wild-type VEGF phage binding activity due to each point mutation was determined by dividing the IC$_{50}$ for the G6 or G6-23 point mutant by the IC$_{50}$ for wild-type G6 or G6-23 Fab respectively.

BIACORE™ Binding Analysis for FabG6 and G6-23 Variants

Figure 9A:
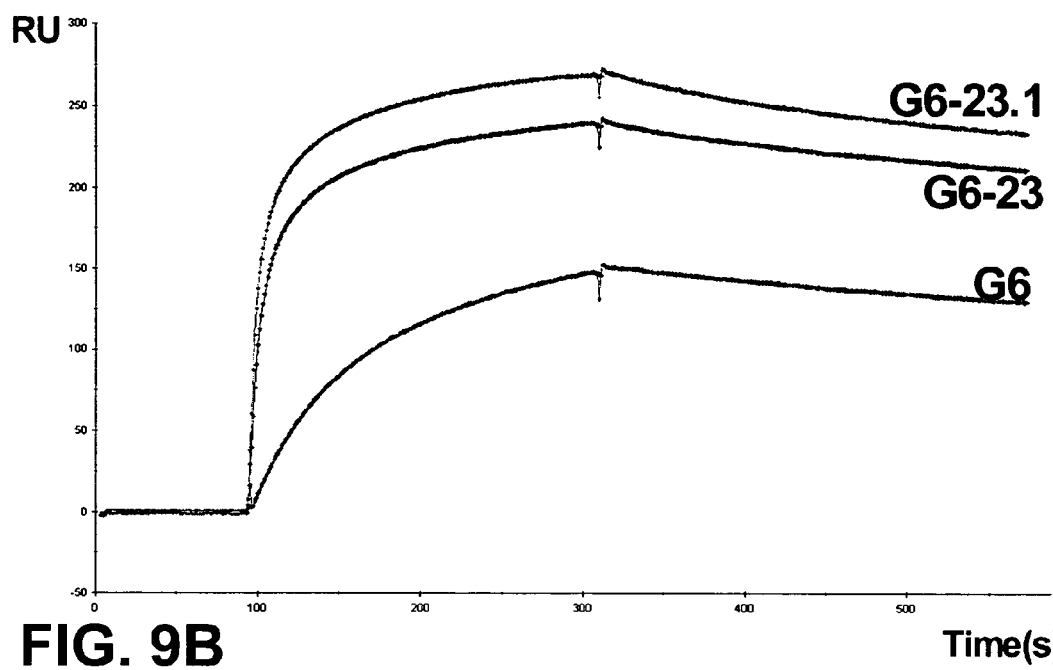
FIG. 9 compares VEGF binding on-rates of G6 and further improved variants of G6-23.
Figure 9B:
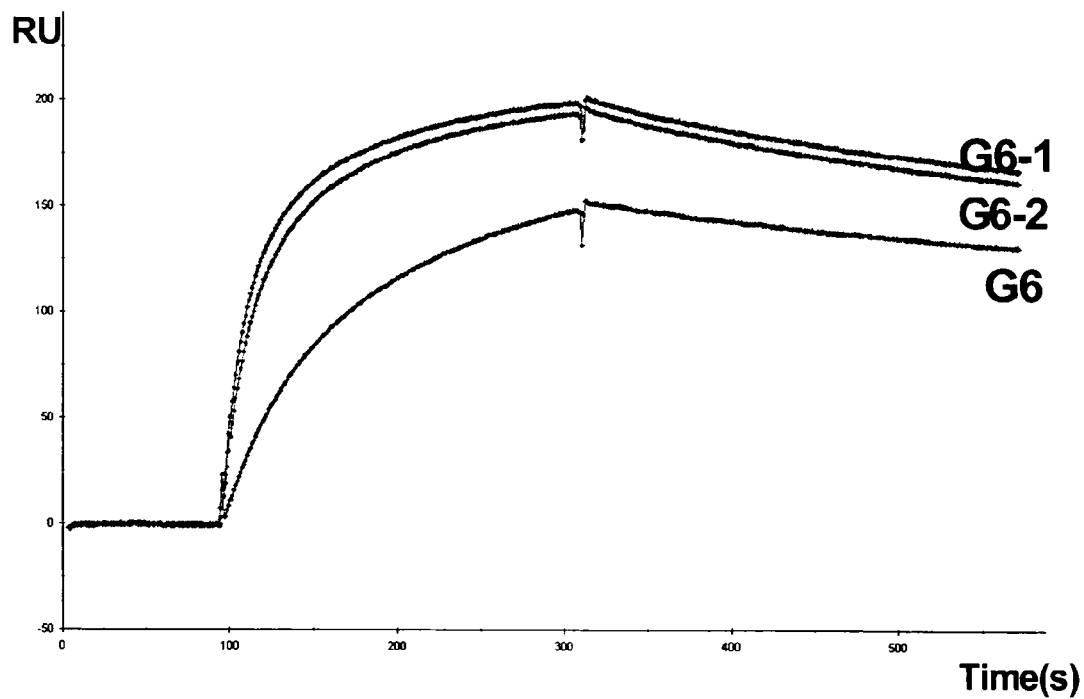

For binding kinetics, surface plasmon resonance (SRP) measurement with a BIAcore™ 3000 (BIAcore, Inc., Piscataway, N.J.) was used as previously described (Karlsson & Fält, (1997) *J. Immunol Methods* 200:121-133). Carboxymethylated dextran biosensor chips (CM5, BIAcore Inc.) were activated with N-ethyl-N'-(3-dimethylaminopropyl)-carbodiimide hydrochloride (EDC) and N-hydroxysuccinimide (NHS) according to the supplier's instructions. Human VEGF (hVEGF) was diluted with 10 mM sodium acetate, pH 4.8, into 5 ug/ml (~0.2 uM) before injected at a flow rate of 5 ul/minute to achieve approximately 100 response units (RU) of coupled protein. Following by the injection of 1M ethanolamine to block unreacted groups. For kinetics measurements, two-fold serial dilutions of G6 or G6-23 Fab variants (0.7 nM to 100 nM) were injected in PBS with 0.05% Tween 20 (PBST) at 25° C. at a flow rate of 25 ul/min. Association rates ($k_{on}$) and dissociation rates ($k_{off}$) were calculated using a simple one-to-one Langmuir binding model (BIAcore™ Evaluation Software version 3.2). The equilibrium dissociation constant (Kd) was calculated as the ratio $k_{off}/k_{on}$. Based on the selection of the phage library, two resides in heavy chain CDR2 appeared to prefer to be alanine or homologous amino acid: HC-Y58 preferred to be alanine, HC-I51 preferred to be valine for binding VEGF. We therefore generated mutant protein Fab with single mutation to confirm the finding from phage libraries. The top graph in FIG. 9 shows that the BIAcore analysis of mutation G6-23-Y58A (G6-23.1) (50 nM) binding to human VEGF coated chip improved the binding on-rate compared to G6-23, which already had a much improved on-rate compared to G6. The lower graph showed the BIAcore analysis of mutant G6-Y58A (G6-1) or G6-I51V (G6-2) to VEGF coated chip. Both had improved on-rate compared to G6. In fact, the double mutant (Y58A/I51V) had an additive effect on the on-rate improvement for G6 and G6-23.

Results of Shotgun Scanning of G6 and G6-23

The results of both shotgun scanning on G6 and G6-23 antibodies indicated that heavy chain CDR side-chains dominated the binding interactions with hVEGF. When mapped onto the X-ray crystal structure of G6 Fab, the functionally important residues in combination represent a portion of the structural epitope, which is defined by the residues in direct contact with hVEGF. The shotgun alanine-scan results revealed the functional epitope comprising the solvent-exposed ridge, which was composed of residues Y32, W33, G54, V96, F97, F98, L99, and Y100a on the heavy chain and Y49 on the light chain. Interestingly, the numbers of functionally important residues revealed by the shotgun homolog-scan were significantly smaller and contained within the group of residues that were important functionally in the shotgun alanine-scan. These hot spots are W33, G54, V96, F97, and L99, which constitute a small patch that overlapped in both scans, suggesting that this surface makes precise contact with the antigen hVEGF that even homologous amino acid substitutions were disruptive. G55 was substituted with alanine only in the homolog scan and it was a highly disruptive, so we believe that G55 is also within this patch.

Other functional important residues revealed by both scans on the heavy chain, G50 and T52, are not part of the solvent-exposed surface of G6 since they are buried inside according to the structural information, acting as scaffolding side-chains that pack against residues in the functional epitope in order to hold this epitope in a binding-competent conformation (C. Wiesmann, unpublished results). As for F95 in CDR-H3 of G6, definitely, alanine substitution at this position in alanine-scan was disruptive; nonetheless, this residue is capable of tolerating tyrosine substitution in homolog-scan, suggesting that its role is in maintaining the structure integrity of the antigen-binding site, which has also been confirmed with structural information.

For Y32, F98, and Y100a, the structural information demonstrated that these surface residues were critical and represented 30% of total heavy chain buried surface areas upon binding hVEGF. The alanine substitutions at these residues were definitely disruptive for affinity with significant function ratios ($F_{wt/mut}$ value) greater than 30, yet interestingly, they tolerated homologous amino acid substitutions (Tyr for Phe and vise versa), suggesting that the aromatic rings for these positions were making the important interactions with hVEGF antigen and adding or removing the hydroxyl group was not making much impact, which were distinct from the above scaffolding residues.

Both shotgun scans identified new mutations in the heavy chain for further affinity improvement, which were I51 V and Y58A. This intriguing observations were verified through producing Fab point mutants, and testing binding activity with competitive ELISA and BIAcore™ (FIG. 23 and FIG. 18). Because I51 and Y58 are not the members of structural epitope (C. Wiesmann, unpublished results), it was believed that the affinity improvement, especially in on-rate, with single or double mutation was not from the introduction of new contact with antigen hVEGF, but probably through optimizing the structure integrity of CDR-H2 loop, to make it more competent for antigen binding.

Based on the structural epitope, G6 light chain CDR residues represented 25% of total structural epitope surface (878 Å$^2$)(C. Wiesmann, unpublished results). Interestingly, the only residue that showed functional importance in both shotgun scanning was Y49 in CDR-L2, which only stood for 2% of the total structural epitope surface, suggesting that most structural epitope residues in the light chain were not involved in the energetic contact with hVEGF antigen. This readout implies that G6 light chain is more important structurally than functionally since it still retained the same sequence as 4D5, the template used for displaying antibody library on the phage where G6 was isolated from in the first place (Carter et al., 1992).

Example 3

G6 and G6-23 Derived Antibodies

(a) Libraries for Selection

Additional anti-VEGF antibodies were obtained by sorting phage from the shotgun alanine and homolog scanning libraries described in Example 2. Specifically, at particular residues, scanned residues were allowed to vary as either wild type or alanine (alanine scan), or either wild type or a homologue residue (homolog scan). (FIGS. 14A and B). For the G6, shotgun alanine and homolog scanning was performed on the G6 light chain and heavy chain separately, resulting in four libraries. For G623, shotgun alanine and homolog scanning was performed on the G623 light chain, and shotgun homolog scanning was performed on G623 heavy chain, resulting in three libraries. A G623 shotgun alanine scanning library was not prepared because, as discussed above, G623 is a high affinity antibody, with most of its residues critical for binding located in the heavy chain. Mutating heavy chain residues to alanine, which means truncating the heavy chain amino acid side chains, would most likely disrupt binding and result in lower affinity antibody variants.

(b) Selecting Anti-VEGF Antibodies

In the first round, a plate sorting strategy was used for selection. Human VEGF (hVEGF, provided by Genentech Research Groups) was immobilized on 96-well Maxisorp immunoplates (NUNC) by incubating wells with 5 ug/ml of protein target over night at 4° C. The plates were blocked with 1% Bovine Serum Albumin (BSA, Sigma) for 30 min in RT, after which 1% Tween20 was added for additional 30 min. The phage libraries described above were incubated on the hVEGF coated immunoplates at a concentration of ~1E13 phage/ml for 1 h in RT under agitation, to allow binding of the phage displayed Fab to the target. After binding, plates were washed 15 times with PBS supplemented with 0.05% Tween20. Bound phage were eluted by incubating wells with 0.1M HCl for 30 min. Elutions were neutralized with 1.0 M Tris base, pH 11. *E. Coli* XL1-blue (Stratagene) were infected with the eluted phage and M13-K07 helper phage (New England Biolabs). The phage was propagated over night for the next round of selection.

The bacterial culture was centrifuged at 8000 rpm for 10 min in a Sorvall GSA rotor at 4° C. and the supernatant collected. The phage was precipitated from the media by addition of ⅕ volume of PEG/NaCl. After 5 min incubation on ice the phage containing culture media was centrifuged at 10 krpm for 15 min in a Sorvall GSA rotor at 4° C. and the supernatant discarded. The remaining phage pellet was resuspended in PBS and centrifuged at 15 krpm for 5 min in a SS-34 rotor at 4° C. to pellet insoluble matter. The supernatant was transferred to a new tube and the phage concentration was estimated by measuring the absorbance at 268 nm.

The following rounds of sorting were performed by a solution-phase sorting method with increasing stringency. Purified phage was incubated with biotinylated hVEGF for 1 hour at RT in PBS with 0.05% Tween20 and 0.5% Superblock (Pierce). After three to ten-fold dilution with superblock, the mixture was added to neutravidin coated wells blocked with 1% BSA (Sigma) and Tween20. The hVEGF-conjugated biotin was allowed to bind the immobilized neutravidin for 10 min. After capture the plate was washed 10-15 times with 0.05% Tween20 in PBS. To study the background, i.e. non-specific binding on the phage to neutravidin, a control reaction lacking the biotinylated hVEGF was added to a coated well. The stringency was increased each round by decreasing antigen concentration in solution, as well as phage concentration or increasing temperature. Increasing number of washes is also a way to achieve more stringent conditions. For the third and fourth round of sorting non-biotinylated hVEGF was added to the reaction mix of biotin-hVEGF and library phage to compete off low affinity binders. By adding 1000 fold excess of competitor for 30 min in 37° C. before capturing, stringency could be increased additionally in the last rounds in order to select for high affinity binders. Manipulating binding and capture times could further increase the stringency from round to round.

For G623 the starting concentration of biotinylated hVEGF was 1 nM for the heavy chain shotgun library and 0.2 nM for the light chain shotgun-scanning library. The concentration was decreased to 0.5 nM and 0.1 nM respectively in the last round. For G6, with lower starting affinity than G623, library sorting was performed with less stringent starting conditions; 5 nM for heavy chain libraries and 2 nM for the light chain libraries, which was decreased to 1.75 and 0.5 nM respectively in the last round of sorting.

To study the enrichment of hVEGF specific Fabs displayed on the phage, 90 ul E. Coli XL-Blue (Stratagene) was infected with 10 ul phage elution from the captured library binding reactions as well as the background mixtures for 30 min at 37° C. A 5 ul culture was plated out on carbencillin supplemented plates and incubated at 37° C. over night. The number of phage particles in the elution could be calculated from the number of colonies from each elution. After the last two rounds of sorting, 50 ul of the above mentioned culture of phagemid-containing bacteria, was plated out on carbencillin-supplemented plates and grown over night at 37° C. The resulting clones were subject to screening.

(c) Single Spot Competitive ELISA

To screen for high affinity clones a high-throughput single point competitive ELISA assay in 96-well format was performed. For both antibodies approximately a hundred clones from the last two rounds of selection were picked randomly and screened in this assay. Phagemid containing E. Coli XL1-blue clones were grown in 400 ul rich 2YT broth, supplemented with carbencillin and M13-KO7 helper phage (New England Biolabs) by shaking over night at 37° C. The culture supernatant of each clone was diluted five times with 0.05% Tween20 and 0.5% BSA in PBS with addition of hVEGF as well as without. After 1 h incubation by shaking in RT, 80 ul of the reactions were transferred to hVEGF-coated immunoplates and incubated for 10 min. The plate was washed 8 times with 0.05% Tween20 in PBS and incubated 30 min with 100 ul anti-M13 antibody horseradish conjugate (New England Biolabs) diluted 5000 times in PBS supplemented with 0.05% Tween20 and 0.5% Bovine Serum Albumin (Sigma). The plates were washed an additional 8 times and developed with TMB substrate for 5 min. The reactions were stopped with 1.0 M $H_3PO_4$ and read spectrophotometrically at 450 nm. To estimate the relative affinity, the ratio of the optical density in the presence of hVEGF to that of the absence of hVEGF was calculated. A low ratio suggests that most Fab displayed on the phage bound hVEGF in solution. As a consequence little Fab can bind to the immobilized hVEGF on the immunoplate. Clones showing lower ratio than wild type (WT) G6 or G623 were selected and, their supernatants used to infect XL1-blue. Phagemid containing bacteria were streaked out on carbencillin plates and grown over night at 37° C. for sequencing.

The selection of the G6 heavy chain libraries resulted in no more than three unique sequences out of the 33 clones analyzed, suggesting that most G6 heavy chain changes result in lost of binding affinity. Furthermore, all unique heavy chain variants derived were from the homolog scan library. It seems that alanine mutation of G6 heavy chain residues can result in a dramatic loss of binding. This intolerance to changes in amino acid sequence selection supports the view that G6 heavy chain harbors many key residues for VEGF binding. The single spot assay result is summarized in Table 2.

TABLE 2

| Single Spot Summary | G623 | | | G6 | |
|---|---|---|---|---|---|
| Library | LC Ala | LC Hom | HC Hom | LC Ala and Hom | HC Ala and Hom |
| Number of clones screened | 84 | 84 | 88 | 88 | 96 |
| Selection Critieria | Clones with significantly lower ratio (Signal + hVEGF/ Signal − hVEGF) than WT | | | | |
| Cut Off | Cut off = 2 fold reduction | | | Cut off = 5 fold reduction | Cut Off = WT ratio |
| Number of Clones with ratio <WT | 33 | 17 | 29 | 56 | 33 |
| Number of unique clones | 17 | 12 | 18 | 53 | 3 |

Results from Single spot assay of G6 and G623 variants. Similar selection crieria was used for both antibody libraries. However, lower cut off was used for G6 LC library compared to G6 HC library as HC variants were expected to show less affinity improvment compared to WT than LC variants. G6 alanine and homologe libraries were pooled before screening of heavy chain and light chain variants.The number of unique clones from the selected pool was determined by DNA sequencing.
LC = Light Chain,
HC = Heavy Chain,
WT = Wild Type.
Hom = Homolog scanning library,
Ala = Alanine scanning library (d) DNA Sequencing and Analysis Clones selected from the single spot screening were grown in 96-well plates with 100 ul 2YT broth supplemented with carbencillin for 2 hours. 1 ul of the culture was subjected to PCR (GeneAmp® PCR System 9700, Applied Biosystems) in order to amplify the DNA encoding the light chain or heavy chain of the different clones. The primers used in the PCR reaction were designed to add M13 universal sequences at the 5' end of the amplified fragment. By adding this sequence, M13 forward primers could be used in the following sequencing reactions. After amplification in 96-well format, the DNA fragments were sequenced by Genentech DNA sequencing group using Big-Dye terminator sequencing reactions and analyzed with an ABI Prism 3700 96-capillary DNA analyzer. (PE Biosystems, Fosters City, Calif.). The heavy and light chain sequences were aligned and identical sequences eliminated. Based on their sequence, clones were selected for affinity determination by IC50 measurement.

(e) Affinity Measurement of Phage Clones

The IC50 values for the phage clones were determined by competitive phage ELISA. A single colony of the selected clones was grown in 5 ml 2YT media supplemented with 50 ug/ml carbencillin for 5 hours. The culture was then infected with M13-K07 helper phage (New England Biolabs) for 1 h and transferred to a 25 ml culture supplemented with 50 ug/ml carbencillin and 50 ug/ml kanamycin. The phage was propagated over night at 37° C. After phage purification as described above, the phage was serially diluted with 0.05% Tween20 and 0.5% BSA in PBS and incubated on a hVEGF coated immunoplate to assess antigen binding at different phage concentrations. The phage dilution that gave 70% saturating signal was used in the IC50 determination assay. Phage was incubated with increasing concentration of hVEGF over night at 37° C. The unbound phage was captured on an hVEGF coated immunoplate for 10 min. The plate was washed, and the bound phage was detected with an anti-M13 antibody horseradish conjugate (New England Biolabs) followed by TMB development, as previously described. The hVEGF concentration that inhibited 50% of phage binding to the immobilized antigen represented the IC50. The signals, which indicate bound phage, were plotted against the hVEGF concentration, and the data was fitted to a competitive binding curve by non-linear regression, enabling $IC_{50}$ determination.

FIGS. 34 and 35 show the $IC_{50}$ values of G6 and G6-23 variants, respectively, as well as the alterations in sequences compared to G6 or G6-23. From the G6 pool, many binders with apparent better affinity than wild type G6 were identified. Many more affinity improved G6 variants were derived from the light chain homolog library (FIG. 34A). However, two higher affinity G6 variants were selected from the heavy chain homolog scan library (FIG. 34B).

Some G6 variants showed up to a hundred-fold affinity improvement, according to the $IC_{50}$ determinations. Of the few G6 heavy chain variants selected, they differed in only a few residues from wild type G6. These heavy chain mutations were located in CDR-H1 and CDR-H2. The conserved nature of the heavy chain, and CDR-H3 in particular, confirmed that most residues important for G6 binding to hVEGF are present in this region. Mutations were more abundant in the G6 light chain variants. They were mainly located in CDR-L1 and CDR-L3 regions, indicating that changing CDR-L2 residues impairs binding instead of improving affinity. A combination of mutations in CDR-L1 and CDR-L3 seem to be favorable for binding, allowing significant affinity improvement compared to wild type.

Most G623 variants showed similar or slightly reduced binding affinity compared to wild type according to their $IC_{50}$ values (FIG. 35). The highest affinity variants were derived from both homolog and alanine light chain shotgun library. Only a small number of high affinity binders were identified in the heavy chain shotgun scan pool. As for G6, heavy chain residues were conserved, and only few mutations present among the clones studied. The light chain variants also showed similar mutation-pattern as G6 variants, with most changes located in CDR-L1 and CDR-L3.

Example 4

Alanine Scanning of hVEGF to Map Anti-VEGF Antibody Binding Sites

To understand the molecular basis of the cross reactivity of G6 and G6-23 and to map their functional epitopes, the relative binding affinities of G6 or G6-23 Fab for individual alanine-substituted hVEGF mutants versus wild type hVEGF were measured using hVEGF displaying phage ELISA as previously described (Muller et al., (1997) *PNAS USA* 94:7192-7197). hVEGF was mutated at sites near the binding epitopes of Flt-1, KDR, the Avastin™ antibody and Y0317 with Kunkel mutagenesis method and phage displaying the individual mutant was generated as described previously (Muller et al., (1997) *PNAS USA* 94:7192-7197). Solution binding phage ELISAs were used to determine the relative binding affinity of each mutant VEGF mutant versus wild type (wt) VEGF on Fab G6-23, G6-23. Briefly, 96-well Maxisorp immunoplates (NUNC) were coated overnight at 4° C. with G6 or G6-23 Fab at a concentration of 2 ug/ml in PBS, and blocked with PBS, 0.5% BSA, and 0.05% Tween20 (PBT) for 2 h at room temperature. Serial dilutions of phage displaying hVEGF mutants in PBT were first incubated on the G6-Fab-coated plates for 15 min at room temperature, and the plates were washed with PBS, 0.05% Tween20 (PBST). Bound phage were detected with anti-M13 monoclonal antibody horseradish peroxidase (Amersham Pharmacia) conjugate diluted 1:5000 in PBT, developed with 3,3',5,5'-tetramethylbenzidine (TMB, Kirkegaard & Perry Labs, Gaithersburg, Md.) substrate for approximately 5 min, quenched with 1.0 M $H_3PO_4$, and read spectrophotometrically at 450 nm. The relative $IC_{50}$ values ($IC_{50,Ala}/IC_{50,wt}$) to represent the fold of reduction in binding affinity, and evaluate the energetic contribution of individual side-chains of hVEGF for interacting with G6 or G6-23 Fab were calculated.

The ratios of IC50 represented the energetic contribution of the individual side chain in the interaction with G6 Fab (FIG. 19). The general folding of alanine mutants, especially ones that had significant reduction in binding G6, was verified by its near-wild type binding to other molecules that have distinct epitopes on VEGF, such as the Avastin™ antibody, Y0317 or Flt-1, as mapped previously (FIG. 19). It is evident that G6 had a distinct epitope as compared to hybridoma derived Avastin™ antibody. All functionally important hVEGF residues for binding G6 were conserved between human and murine VEGF, thus explaining in part its cross reactivity. The Fab of the Avastin™ antibody (Fab-12) and Y0317, on the other hand, lost most of their binding to VEGF upon alanine substitution at residue Gly88, which is Ser in mVEGF. To visualize the epitope on a VEGF molecule, functionally important residues for binding G6 were highlighted on the surface of hVEGF crystal structure according to their relative affinities for G6. G6 epitope mapped to a patch that was conserved between human and mouse VEGF and dotted with a few energetically important residues, Phe17, Tyr21, Tyr, Ile83 and Gln89, which clustered in close proximity. This is indicative of a functional epitope with an interaction "hot spot".

We next compared the functional epitope of G6 to the structural epitope of Fab-12 (same as Y0317) or Flt-1D2, the VEGF residues that became buried upon forming complex with these molecules based on the crystal structure of the complex. Interestingly, the functional epitope of G6 on VEGF matches the structural epitope for Flt-1D2 more closely than does the structural epitope of Fab-12. Further, G6 shared similar hot spot as Flt-1 for VEGF since residues Phe17, Tyr21 and Tyr25 were highly important energetically for both interactions (FIG. 19). Fab-12 or Y0317, on the other hand, centered on the non-conserved and functionally important residue, Gly88, which is believed to be the reason for its lack of binding to mVEGF. It appeared that phage library derived antibody G6 targeted a conserved epitope on VEGF in a nearly identical fashion as VEGF receptor, while a hybridoma for hVEGF avoided generating a self-reactive anti-mouse antibody. There was, however, sufficient overlap between the two epitopes of G6 and Fab-12 as the binding of G6 and Fab-12 (Y0317) to hVEGF were mutually exclusive (data not shown).

Comparing the important sites on hVEGF for binding G6 and G6-23 indicated that the residues contributing most energetically, F17, Y21, and Y25 on 20's helix, and Q89A on 80's loop, remained the same, except the impact of residues on binding seemed to change (FIG. 19). For example, residues Y21 and Q89 when changed to alanine became a bigger hit for G6-23 than for G6. There were sites that modestly decreased its relative impact of its side chain in binding to G6-23 as compared to G6, e.g., I83, H86, and I91A.

There was no new functionally important residues observed for the affinity-improved version, G6-23, yet a shuffling of energetic contributions among these functionally important residues in both antibodies, which was consistent with the finding structurally that identical positions of hVEGF were buried upon complexing with G6 or G6-23 (structural data below). When mapping these functionally important residues along with other moderate contributors on hVEGF structure, they appeared as a contiguous patch within the structural epitope of Flt-1D2, which were highly conserved between human and mouse VEGF, which explains the fact that both antibodies had equal affinity for both VEGF. By comparison of the footprint of both structural and functional epitope for G6 on hVEGF structure, it clearly showed that heavy chain CDR residues were the ones making contact with the positions on VEGF where alanine mutation were disruptive, such as the 20's helix and 80' loop of hVEGF, whereas light chain CDR residues contact the 60's loop of hVEGF where the side chains were not functionally as important.

The dilutions of phage that produced the sub-maximal binding signal (50-70%) were used in the solution competition assay where wild type or mutant hVEGF phage in PBT buffer were first incubated with increasing concentration of competing G6 or G6-23 Fab for 1-2 h at room temperature, then the mixtures were transferred to G6-Fab-coated plates to capture the unbound phage for 15 min, and bound phage were detected as described above. Competition curves were fit with a four-parameter non-linear regression curve-fitting program (Kaleidagraph, Synergy Software) to determine the $IC_{50}$ values which were calculated as the concentration of G6 or G6-23 Fab in solution binding stage that inhibited 50% of the phage from binding to immobilized G6 Fab. The ratio of the $IC_{50}$ of mutant versus wild type hVEGF is the relative fold difference in binding affinities. For mutants that have severe reduced binding to G6-Fab-coated plate, Fab12 (Presta, 1997) or Flt-1$_{D1-5}$ were used as coat to capture to mutant phage after incubations with G6 or G6-23 Fab. Binding of hVEGF-phage to G6, G6-23 Fab, Fab12, Fab and Flt-1$_{D1-5}$ were mutually exclusive as tested with wild type VEGF phage.

Example 5

Structural Mapping of VEGF Binding Sites on G6 and G6-23 and of G6 Binding Sites on VEGF by Crystallography Expression Purification Crystallization and Structural Analysis Residues 8-109 of human VEGF were expressed, refolded, and purified as previously described (Christinger, H. W., et al., (1996). *Prot, Struct. Funct. Genet.* 26, 353-357).

G6 Fab was expressed in *E. coli* and the cell paste was thawed into PBS, 25 mM EDTA, 1 mM PMSF. The mixture was homogenized and then passed twice through a microfluidizer. The suspension was then centrifuged at 12 k rpm for 60 min. The protein was loaded onto a Protein G column previously equilibrated with PBS at 5 ml/min. The column was washed with PBS to base line and then eluted with 0.58% acetic acid. Fractions containing G6 Fab were pooled and loaded directly onto a SP-sepharose column equilibrated with 20 mM MES, pH 5.5. The protein was eluted with a salt gradient of 0 to 0.25 M NaCl.

G6 eluted from the SP-sepharose column was mixed with hVEGF8-109 and further purified over a Superdex 200 column equilibrated with 30 mM Tris.Cl, pH 7.5 and 0.4 M NaCl. Fractions containing the complex were pooled, concentrated and used in crystallization trials. Crystals were grown at 19° C. using vapor diffusion method in sitting drops. Crystallization buffer containing 2.0 M ammonium sulfate and 5% iso-propanol were mixed in equal volume with protein solution (8 mg/ml protein). Crystals appeared after 3 days and belonged to space group P3121 with cell dimensions of a=117.9 Å and c=212.6 Å. These crystal forms contained 1 complex comprising of a VEGF dimer and 2 Fab molecules in the asymmetric unit.

The crystals were soaked in mother liquor, dipped in artificial mother liquor containing 25% glycerol and flash frozen in liquid nitrogen. A 2.8 Å data set was collected on an SSRL Synchrotron Source on beam line 9-1. The data were reduced using programs DENZO and SCALEPACK (Otwinowski, Z. (1993). DENZO. In Data Collection and Processing, L. Sawyer, N. Isaacs, and S. Bailey, eds. (Warrington, UK: 1993).

Structure Determination and Refinement

The structure was solved by molecular replacement using the coordinates of VEGF (from PDB code 1FLT), constant and variable domains of the antibody in 1BJ1 (Brookhaven data base) and program AMoRe (CCP4 1994). Model building was done with program O and refinement with Refmac (CCP4 1994). The final Rvalue and Rfree are 19.87% and 23.92%, respectively.

The following programs were used to calculate the surface areas of interaction RESAREA version 3.2: Aug. 5, 1993 and AREAIMOL version 3.2: Dec. 19, 1995. These programs are part of the CCP4 suite Collaborative Computational Project, Number 4. 1994 ("The CCP4 Suite: Programs for Protein Crystallography" *Acta Cryst*. D50, 760-763).

The surface area of each residue of an anti-VEGF antibody that is buried in VEGF (Å$^2$) is reported below together with the percentage of the total surface area of the residue that is buried. Also reported is the surface area of each residue of VEGF antibod that is buried in VEGF (Å$^2$) is reported below together with the percentage of the total surface area of the residue that is buried. See values for G6:VEGF, G6-23:VEGF, Fab-12:VEGF, YADS-1:VEGF and YADS-2:VEGF complex below. In all cases, because VEGF is a dimer, the residue numbers of VEGF referring to monomer 1 (of the VEGF dimer) are 8-109 and residue numbers of VEGF referring to monomer 2 (of the VEGF dimer) are 1008-1109. The first column in each table below recites the residue numbers of the protein being examined (either VEGF or an anti-VEGF antibody) (e.g., for section (a) below, PHE A 17 refers to F17, LYS A1048 refers to K48; MET A1081 refers to MET 81 of VEGF). The second column recites the buried surface of that residue (Å$^2$). The third column recites the buried surface for that residue as a percentage of the surface area of the whole residue.

(a) VEGF:G6 Complex

TABLE 3

Residues of VEGF in contact with G6

| Residue Nr | buried surface | buried surface in % |
|---|---|---|
| PHE A 17 | 17.00 | 54.84% of 31.00 |
| MET A 18 | 59.00 | 57.84% of 102.00 |
| TYR A 21 | 62.00 | 100.00% of 62.00 |
| GLN A 22 | 65.00 | 48.51% of 134.00 |
| TYR A 25 | 54.00 | 70.13% of 77.00 |
| ASP A 63 | 54.00 | 68.35% of 79.00 |
| GLU A 64 | 31.00 | 23.66% of 131.00 |
| LEU A 66 | 33.00 | 73.33% of 45.00 |
| CYS A 104 | 10.00 | 34.48% of 29.00 |
| PRO A 106 | 49.00 | 48.51% of 101.00 |
| LYS A 1048 | 40.00 | 86.96% of 46.00 |
| MET A 1081 | 17.00 | 94.44% of 18.00 |
| ILE A 1083 | 25.00 | 89.29% of 28.00 |
| LYS A 1084 | 1.00 | 0.88% of 114.00 |
| PRO A 1085 | 2.00 | 3.77% of 53.00 |
| HIS A 1086 | 103.00 | 53.65% of 192.00 |
| GLN A 1087 | 19.00 | 12.18% of 156.00 |
| GLY A 1088 | 13.00 | 38.24% of 34.00 |
| GLN A 1089 | 119.00 | 88.15% of 135.00 |
| HIS A 1090 | 22.00 | 20.37% of 108.00 |
| ILE A 1091 | 30.00 | 47.62% of 63.00 |

CHAIN A DIFF-AREA: 825.0 (7.47% of 11043.0 total AREA for this chain)

TABLE 4

Residues of G6 in contact with VEGF
Residues 1:211 refer to the light chain.
Residues 1001:1223 refer to heavy chain

| Residue Nr | buried surface | buried surface in % |
|---|---|---|
| ASP B 28 | 38.00 | 38.00% of 100.00 |
| SER B 30 | 23.00 | 47.92% of 48.00 |
| TYR B 49 | 19.00 | 65.52% of 29.00 |
| PHE B 53 | 25.00 | 21.55% of 116.00 |
| TYR B 92 | 70.00 | 94.59% of 74.00 |
| THR B 93 | 19.00 | 38.00% of 50.00 |
| SER B 1030 | 17.00 | 21.52% of 79.00 |
| ASP B 1031 | 96.00 | 84.21% of 114.00 |
| TYR B 1032 | 24.00 | 41.38% of 58.00 |
| TRP B 1033 | 52.00 | 77.61% of 67.00 |
| ILE B 1051 | 14.00 | 29.79% of 47.00 |
| PRO B 1053 | 38.00 | 97.44% of 39.00 |
| ALA B 1054 | 26.00 | 42.62% of 61.00 |
| GLY B 1055 | 49.00 | 96.08% of 51.00 |
| GLY B 1056 | 39.00 | 97.50% of 40.00 |
| TYR B 1057 | 38.00 | 22.35% of 170.00 |
| PHE B 1099 | 2.00 | 100.00% of 2.00 |
| PHE B 1101 | 101.00 | 90.99% of 111.00 |
| PHE B 1102 | 109.00 | 84.50% of 129.00 |
| LEU B 1103 | 10.00 | 62.50% of 16.00 |

TABLE 4-continued

Residues of G6 in contact with VEGF
Residues 1:211 refer to the light chain.
Residues 1001:1223 refer to heavy chain

| Residue Nr | buried surface | buried surface in % |
|---|---|---|
| PRO B 1104 | 5.00 | 13.16% of 38.00 |
| TYR B 1105 | 42.00 | 66.67% of 63.00 |

CHAIN B DIFF-AREA: 856.0 (4.44% of 19280.0 total AREA for this chain)
TOTAL DIFF-AREA: 1681.0 (5.54% of 30323.0 total AREA over all chains)

(b) VEGF:G6-23 Complex

TABLE 5

Residues of VEGF in contact with G6-23
Residues 8:109 relate to monomer 1 (of the VEGF dimer).
Residues 1008:1109 to monomer 2 (of the VEGF dimer)

| Residue Nr | buried surface | buried surface in % |
|---|---|---|
| LYS A 48 | 35.00 | 64.81% of 54.00 |
| MET A 81 | 23.00 | 95.83% of 24.00 |
| ILE A 83 | 18.00 | 90.00% of 20.00 |
| LYS A 84 | 1.00 | 1.04% of 96.00 |
| PRO A 85 | 2.00 | 4.76% of 42.00 |
| HIS A 86 | 114.00 | 55.34% of 206.00 |
| GLN A 87 | 18.00 | 11.18% of 161.00 |
| GLY A 88 | 14.00 | 42.42% of 33.00 |
| GLN A 89 | 116.00 | 87.88% of 132.00 |
| HIS A 90 | 22.00 | 16.30% of 135.00 |
| ILE A 91 | 33.00 | 49.25% of 67.00 |
| PHE A 1017 | 24.00 | 68.57% of 35.00 |
| MET A 1018 | 56.00 | 46.67% of 120.00 |
| TYR A 1021 | 72.00 | 100.00% of 72.00 |
| GLN A 1022 | 68.00 | 56.20% of 121.00 |
| TYR A 1025 | 58.00 | 67.44% of 86.00 |
| CYS A 1061 | 3.00 | 16.67% of 18.00 |
| ASP A 1063 | 46.00 | 58.97% of 78.00 |
| GLY A 1065 | 7.00 | 18.92% of 37.00 |
| LEU A 1066 | 38.00 | 70.37% of 54.00 |
| GLU A 1103 | 5.00 | 6.17% of 81.00 |
| CYS A 1104 | 16.00 | 72.73% of 22.00 |
| ARG A 1105 | 2.00 | 1.80% of 111.00 |
| PRO A 1106 | 67.00 | 68.37% of 98.00 |

CHAIN A DIFF-AREA: 858.0 (7.65% of 11223.0 total AREA for this chain)

TABLE 6

Residues of G6-23 in contact with VEGF
Residues 1:211 refer to the light chain.
Residues 1001:1223 refer to the heavy chain.

| Residue Nr | buried surface | buried surface in % |
|---|---|---|
| ASP B 28 | 25.00 | 27.17% of 92.00 |
| SER B 30 | 44.00 | 75.86% of 58.00 |
| THR B 31 | 6.00 | 10.91% of 55.00 |
| ALA B 32 | 1.00 | 33.33% of 3.00 |
| TYR B 49 | 21.00 | 58.33% of 36.00 |
| PHE B 53 | 21.00 | 19.27% of 109.00 |
| TYR B 92 | 72.00 | 71.29% of 101.00 |
| SER B 1030 | 18.00 | 24.00% of 75.00 |
| ASP B 1031 | 96.00 | 84.21% of 114.00 |
| TYR B 1032 | 28.00 | 48.28% of 58.00 |
| TRP B 1033 | 47.00 | 73.44% of 64.00 |
| ILE B 1051 | 14.00 | 32.56% of 43.00 |
| PRO B 1053 | 29.00 | 65.91% of 44.00 |
| ALA B 1054 | 28.00 | 57.14% of 49.00 |
| GLY B 1055 | 51.00 | 89.47% of 57.00 |
| GLY B 1056 | 34.00 | 97.14% of 35.00 |
| TYR B 1057 | 37.00 | 21.76% of 170.00 |

TABLE 6-continued

Residues of G6-23 in contact with VEGF
Residues 1:211 refer to the light chain.
Residues 1001:1223 refer to the heavy chain.

| Residue Nr | buried surface | buried surface in % |
|---|---|---|
| PHE B 1099 | 1.00 | 33.33% of 3.00 |
| PHE B 1101 | 113.00 | 86.92% of 130.00 |
| PHE B 1102 | 101.00 | 84.17% of 120.00 |
| LEU B 1103 | 12.00 | 80.00% of 15.00 |
| PRO B 1104 | 4.00 | 8.00% of 50.00 |
| TYR B 1105 | 54.00 | 68.35% of 79.00 |

CHAIN B DIFF-AREA: 857.0 (4.38% of 19547.0 total AREA for this chain)
TOTAL DIFF-AREA: 1715.0 (5.57% of 30770.0 total AREA over all chains)

(c) VEGF: Fab-12

TABLE 7

Residues of VEGF in contact with Fab-12 (PDB code 1bj1)
Residues 8:109 relate to monomer 1 (of the VEGF dimer).
Residues 1008:1109 to monomer 2 (of the VEGF dimer)

| Residue Nr | buried surface | buried surface in % |
|---|---|---|
| TYR A 45 | 30.00 | 48.39% of 62.00 |
| LYS A 48 | 23.00 | 41.82% of 55.00 |
| GLN A 79 | 13.00 | 38.24% of 34.00 |
| TYR A 45 | 30.00 | 48.39% of 62.00 |
| LYS A 48 | 23.00 | 41.82% of 55.00 |
| GLN A 79 | 13.00 | 38.24% of 34.00 |
| ILE A 80 | 1.00 | 100.00% of 1.00 |
| MET A 81 | 37.00 | 100.00% of 37.00 |
| ARG A 82 | 53.00 | 85.48% of 62.00 |
| ILE A 83 | 30.00 | 71.43% of 42.00 |
| LYS A 84 | 11.00 | 20.00% of 55.00 |
| HIS A 86 | 77.00 | 37.93% of 203.00 |
| GLN A 87 | 119.00 | 80.95% of 147.00 |
| GLY A 88 | 38.00 | 100.00% of 38.00 |
| GLN A 89 | 134.00 | 100.00% of 134.00 |
| HIS A 90 | 114.00 | 100.00% of 114.00 |
| ILE A 91 | 75.00 | 93.75% of 80.00 |
| GLY A 92 | 33.00 | 100.00% of 33.00 |
| GLU A 93 | 83.00 | 62.41% of 133.00 |
| MET A 94 | 5.00 | 50.00% of 10.00 |
| PHE A 1017 | 25.00 | 55.56% of 45.00 |
| TYR A 1021 | 16.00 | 21.92% of 73.00 |

CHAIN A DIFF-AREA: 917.0 (8.42% of 10895.0 total AREA for this chain)

TABLE 8

Residues of Fab-12 in contact with VEGF
Residues 1:211 refer to the light chain.
Residues 1001:1223 refer to the heavy chain.

| Residue Nr | buried surface | buried surface in % |
|---|---|---|
| TYR B 91 | 4.00 | 40.00% of 10.00 |
| SER B 92 | 12.00 | 25.00% of 48.00 |
| THR B 93 | 2.00 | 4.44% of 45.00 |
| VAL B 94 | 34.00 | 37.36% of 91.00 |
| TRP B 96 | 19.00 | 86.36% of 22.00 |
| THR B 1030 | 5.00 | 11.36% of 44.00 |
| ASN B 1031 | 85.00 | 80.19% of 106.00 |
| TYR B 1032 | 22.00 | 52.38% of 42.00 |
| GLY B 1033 | 9.00 | 100.00% of 9.00 |
| TRP B 1050 | 53.00 | 91.38% of 58.00 |
| ASN B 1052 | 31.00 | 86.11% of 36.00 |
| THR B 1053 | 3.00 | 75.00% of 4.00 |
| TYR B 1054 | 93.00 | 51.96% of 179.00 |
| THR B 1055 | 6.00 | 7.41% of 81.00 |
| THR B 1059 | 29.00 | 53.70% of 54.00 |

TABLE 8-continued

Residues of Fab-12 in contact with VEGF
Residues 1:211 refer to the light chain.
Residues 1001:1223 refer to the heavy chain.

| Residue Nr | buried surface | buried surface in % |
|---|---|---|
| TYR B 1099 | 12.00 | 100.00% of 12.00 |
| PRO B 1100 | 13.00 | 81.25% of 16.00 |
| HIS B 1101 | 58.00 | 56.31% of 103.00 |
| TYR B 1102 | 122.00 | 95.31% of 128.00 |
| TYR B 1103 | 34.00 | 18.68% of 182.00 |
| GLY B 1104 | 41.00 | 50.62% of 81.00 |
| SER B 1105 | 4.00 | 6.67% of 60.00 |
| SER B 1106 | 41.00 | 77.36% of 53.00 |
| HIS B 1107 | 4.00 | 23.53% of 17.00 |
| TRP B 1108 | 96.00 | 97.96% of 98.00 |

CHAIN B DIFF-AREA: 832.0 (4.29% of 19409.0 total AREA for this chain)
TOTAL DIFF-AREA: 1749.0 (5.77% of 30304.0 total AREA over all chains)

The residues having greater than 5 Å$^2$ buried surface area and/or greater than 5% buried were considered significantly contacted. These results help describe the regions in VEGF and the regions in the antibodies that contact one another. Together with functional data relating to the binding VEGF presented earlier, common features of the G6 series of antibodies and the B20 series of antibodies (structural data not shown) can be observed. G6, G6-23 and B20 antibodies, as well as others bound to both mouse and human VEGF with relatively high affinities, unlike Fab-12 or Y0317 (data not shown). Mutations of human VEGF G88A or G88S severely effected binding of Fab-12 or Y0317 to VEGF, whereas the G6 series of antibodies and the B20 series of antibodies (structural data not shown) were relatively unaffected. Further, the binding of antibodies such as Fab-12 to VEGF resulted in the surface area of G88 being 100% buried whereas the binding of G6 and G6-23 resulted in G88 being less than 66% buried. Thus, it is believed that although partial contact with G88 is allowable for antibodies having the property of recognizing both mouse and human VEGF with good affinity, it is not likely that antibodies that contact human VEGF such that the surface area of Gly88 of human VEGF is 80% or more buried will bind to both mouse and human VEGF with good affinity. The functional epitope mapping results also show that the footprint of the G series of antibodies on VEGF is different from Fab-12 in that it has a greater contact extending into the 20's helix of VEGF (approximately residues numbered 10-30 of human VEGF) as well as contacting residues in the 80s loop (approximately residues 80-94 of human VEGF). The structural studies correlate well with the functional studies (see FIG. 19) in that mutations to several residues in the 20s helix decrease binding of the G6 and B20 series antibodies. The functional studies described in FIG. 19 indicate that the G6 and the B20 series antibodies interact well with residues that are important for both Flt-1 and KDR binding as compared to A4.6.1

Example 6

Tetrinomial Diversity Libraries

To investigate whether a small subsets of the natural amino acids could be used to generate antigen-binding surfaces, we constructed maybe heavy chain phage-displayed libraries of antigen-binding fragments (Fabs) based on the humanized Fab4D5 (30), which recognizes the extracellular domain of the human receptor tyrosine kinase ErbB2 (Fendly, B. M., et al., (1990), Cancer Res. 50:1550-8. First, a previously described phagemid was modified to display bivalent Fab4D5 (Fab'-zip) on the surface of M13 bacteriophage. The gene coding for the Fab'-zip was fused to the C-terminal domain of the M13 gene-3 minor coat protein and expressed under the control of the phoA promoter (Lee, V., et al., (2004) *J. Immunol. Methods* 284:119-132). The phagemid was modified by a single mutation in the light chain (R66G) and by the introduction of TAA stop codons into all three heavy chain CDRs. For each library construction, the resulting phagemid (pV-0116c) was used as the "stop template" in a mutagenesis reaction with oligonucleotides designed to repair simultaneously the stop codons and introduce designed mutations at the desired sites, as described previously (Sidhu, S. S. et al., (2004) *J. Mol. Biol.* 338(2):299-310; Sidhu, S S et al., (2000) *Methods in Enzymology* 328:333-363).

a. Construction of KMT Library

Solvent-accessible positions within the heavy chain CDRs encoded by the phagemid were replaced by a single type of degenerate codon, KMT, that produced equal proportions of four amino acids (Y, A, D, S). The number of possible tetranomial combinations of the 20 natural amino acids is too great to be investigated exhaustively, and thus, we chose combinations that fulfilled two criteria. Firstly, we were restricted to combinations that could be accessed with standard DNA synthesis methods. Secondly, we ensured that each tetranomial set contained at least one small amino acid (glycine, serine or alanine), as we reasoned that small residues would provide conformational flexibility and prevent steric crowding. A total of 18 positions were chosen for randomization: positions 28 and 30-33 in CDR-H1; positions 50, 52, 53, 54, 56 and 58 in CDR-H2; and positions 95-100a in CDR-H3. Each constructed library contained ~$10^{10}$ unique members, and thus, the library diversities were only about one order of magnitude less than the maximum theoretical diversity ($4^{18}$=$7\times10^{10}$). The KMT library name corresponds to the degenerate codon used; equimolar DNA degeneracies are represented by IUB code (K=G/T, M=A/C, R=A/G, S=G/C, W=A/T, Y=C/T).

b. Sorting and Binding Assays for the KMT Library

Phage from the naïve heavy chain library was cycled through rounds of binding selection with either human vascular endothelial growth factor (hVEGF) or other antigens on 96-well Maxisorp immunoplates (NUNC) as the capture target, as described previously (Sidhu, S. S. et al., (2004) supra; Sidhu, S S et al., (2000) *Methods in Enzymology* 328:333-363). Bound phage were eluted with 0.1 M HCl for 10 min and the eluant was neutralized with 1.0 M Tris base. Phage were propogated in *E. coli* XL 1-blue (Stratagene) with the addition of M13-KO7 helper phage (New England Biolabs).

After three rounds of selection, individual clones were grown in a 96-well format in 500 ul of 2YT broth supplemented with carbenicillin and M13-KO7. The culture supernatants were used in phage ELISAs to detect positive clones that bound to antigen-coated plates but not to BSA-coated plates (Sidhu, S. S. et al., (2004) supra). Positive clones were subjected to DNA sequence analysis assessed for antigen-specific binding with phage enzyme-linked immunosorbant assays (ELISAs) (Sidhu, S. S. et al., (2004) supra). Approximately 100 clones were screened against each antigen and specific binding clones were identified in each case. DNA sequencing revealed the number of unique clones isolated against each antigen. At least one tyrosine-containing library was successful against each antigen. In particular, Library-KMT was successful against 3 of the 4 antigens and generated 11 unique clones against human vascular endothelial growth factor (hVEGF).

c. Second KMT Library—Light Chain Diversity

We constructed new versions of the KMT Library in which the CDR-H1 and CDR-H2 diversities were the same as described above, but the diversity of CDR-H3 was increased by allowing for all possible length variations ranging from 3-15 residues inserted between residues 94 and 100b. All together, the pooled libraries contained a diversity of ~$10^{10}$ unique members that were cycled through selections for binding to hVEGF. Phage ELISA screens identified 93 hVEGF binders and DNA sequencing revealed 15 unique sequences (FIG. 36). Most of the clones contained CDR-H3 sequences with seven inserted residues, but we also identified two clones that contained longer insertions. The unique clones were subjected to competitive phage ELISAs (Sidhu, S. S. et al., (2004) supra) and exhibited estimated affinities in the 10 micromolar range (data not shown).

c. Affinity Maturation of Unique Clones from Second KMT Library

We next investigated whether the low affinity anti-VEGF clones could be affinity matured to obtain Fabs with affinities comparable to those of natural antibodies. To this end, we recombined the 15 heavy chains (FIG. 36) with a light chain library in which 12 solvent-accessible positions were replaced with the same tetranomial KMT codon. Specifically, the following light chain positions were randomized: positions 28-32 in CDR-L1, positions 50 and 53 in CDR-L2, and positions 91-94 and 96 in CDR-L3. The libraries contained ~$10^{10}$ unique members which greatly exceeded the theoretical diversity of possible light chains ($4^{12}$=$2\times10^7$). The phagemid selected for the display of a heavy chain sequence and above light chain sequence had been modified by the introduction of TAA stop codons into all three light chain CDRs. The resulting phagemid was used as the "stop template" in a mutagenesis reaction that repaired the stop codons and introduced desired mutations, as described above.

Phage from the light chain libraries were incubated for 2 h at room temperature in PBS, 0.05% Tween 20 (Sigma), 0.5% Superblock (Pierce) with 100 nM hVEGF biotinylated with Sulfo-NHS-LC-Biotin reagent (Pierce). Biotinylated hVEGF and bound phage were captured for 5 min with neutravidin (Pierce) immobilized on Maxisorp immunoplates. The plates were washed with PBS, 0.05% Tween 20 and the bound phage were eluted and propagated for additional rounds of selection, as described above.

After selection, individual clones were grown in a 96-well format in 500 ul of 2YT broth supplemented with carbenicillin and M13-KO7. The culture supernatants were used in phage ELISAs to detect positive clones that bound to antigen-coated plates but not to BSA-coated plates (Sidhu, S. S. et al., (2004) supra). Positive clones were subjected to DNA sequence analysis.

hVEGF in solution was used for a high stringency selection. We sequenced 256 clones and identified 64 unique light chains combined with 9 of the 15 heavy chains (top 9 sequences in FIG. 36). Competitive phage ELISAs were used to estimate affinities of clones (Sidhu, S. S. et al., (2004) supra). Such ELISAs were carried out generally as follows. Phage clones were propagated from a single colony by growing in 40 ml of 2YT culture supplemented with carbenicillin and KO7 helper phage overnight at 30° C. Phage purified by PEG/NaCl precipitation were first serially diluted in PBST and tested for binding to an antigen-coated plate (hVEGF or mVEGF). The dilution that gave 50-70% saturating signal was used in the solution binding assay in which phage were first incubated with increasing concentration of antigen for 1-2 h and then transferred to antigen coated plate to capture the unbound phage for 10-15 min. An $IC_{50}$ was calculated as the concentration of antigen in solution binding stage that inhibited 50% of the phage from binding to immobilized antigen. The three highest affinity phage clones were YADS1, YADS2 and YADS3, which clones were converted into Fabs.

d. YADS1, 2 and 3 Fab Binding Affinities

YADS1, 2 and 3 were purified as free Fab proteins for detailed analysis. The sequence of these Fabs are provided below. See also FIG. 39.

YADS1 Light Chain
(SEQ ID NO: 19)
DIQMTQSPSSLSASVGDRVTITCRASQASYSSVAWYQQKPGKAPKLLIYA

ASYLYSGVPSRFSGSGSGTDFTLTISSLQPEDFATYYCQSSASPATFGQG

TKVEIKRTVAAPSVFIFPPSDEQLKSGTASVVCLLNNFYPREAKVQWKVD

NALQSGNSQESVTEQDSKDSTYSLSSTLTLSKADYEKHKVYACEVTHQGL

SSPVTKSFNRGEC

YADS1 Heavy Chain
(SEQ ID NO: 20)
MKKNIAFLLASMFVFSIATNAYAEVQLVESGGGLVQPGGSLRLSCAASGF

DIYDDDIHWVRQAPGKGLEWVAYIAPSYGYTDYADSVKGRFTISADTSKN

TAYLQMNSLRAEDTAVYYCSRSSDASYSYSAMDYWGQGTLVTVSSASTKG

PSVFPLAPSSKSTSGGTAALGCLVKDYFPEPVTVSWNSGALTSGVHTFPA

VLQSSGLYSLSSVVTVPSSSLGTQTYICNVNHKPSNTKVDKKVEPKSCDK

TH

YADS2 Light Chain
(SEQ ID NO: 21)
DIQMTQSPSSLSASVGDRVTITCRASQSYAYAVAWYQQKPGKAPKLLIYD

ASYLYSGVPSRFSGSGSGTDFTLTISSLQPEDFATYYCQQAYSSPDTFGQ

GTKVE1KRTVAAPSVFWPPSDEQLKSGTASVVCLLNTTTYPREAKVQWKV

DNALQSGNSQESVTEQDSKDSTYSLSSTLTLSKADYEKHKVYACEVTHQG

LSSPVTKSFNRGEC

YADS2 Heavy Chain
(SEQ ID NO: 22)
MKKNIAELLASMFVFSIATNAYAEVQLVESGGGLVQPGGSLRLSCAASGF

AISDYDIHWVRQAPGKGLIWVAD1APYAGATAYADSVKGRFTISADTSKN

TAYLQMNSLREDTVYYCSRSSYAYYAAMDYWGQGTLVTVSSASTKGPSVF

PLAPSSKSTSGGTAALGCLVKDYFPEPVTVSWNSGALTSGVHTFPAVLQS

SGLYSLSSVVTVPSSSLGTQTYICNVKUKiPSNTKVDKKVEPKSCDKTH

YADS3 Light Chain
(SEQ ID NO: 23)
DIQMTQSPSSLSASVGDRVTITCRASQASYYDVAWYQQKPGKAPKLLIYA

ASYLYSGVPSRFSGSGSGTDFTLTISSLQPEDFATYYCQQYYYAPATFGQ

GTKVEIIKRTVAAPSVFTFPPSDEQLKSGTASVVCLLNNFYPREAKVQWK

VDNALQSGNSQESVTEQDSKDSTYSLSSTLTLSKADYEKHKVYACEVTHQ

GLSSPVTKSFNRGEC

YADS3 Heavy Chain
(SEQ ID NO: 24)
MKKNIAFLLASMFVFSIATNAYAEVQLVESGGGLVQPGGSLRLSCAASGF

SISDYDIHWVRQAPGKGLEWVAAIAPYSGSTYYADSVKGRETISADTSKN

TAYLQMNSLRAEDTAVYYCSRSSYAYYSAMDYWGQGTLVTVSSASTKGPS

VFPLAPSSKSTSGGTAALGCLVKDYFPEPVTVSWNSGALTSGVHTFPAVL

QSSGLYSLSSVVTVPSSSLGTQTYICNVNHKPSNTKVDKKVEPKSCDKTH

Fab proteins were purified from *E. coli* shake-flask cultures, as described previously (Muller, Y A et al., (1998) *Structure* 6:1153-1167). Generally, the variable domains were cloned into vectors designed for Fab expression in *E. coli* or transient IgG expression in mammalian cells. The Fab expression vector was derived from the phage display phagemid by deleting the sequence encoding for cP3 and adding a terminator sequence (GCTCGGTTGCCGC-CGGGCGTTTTTAT) (SEQ ID NO:920) about 20 nucleotides downstream from the stop codon at the end of $C_H1$. Fab protein was generated by growing the transformed 34B8 *E. coli* cells in AP5 media at 30° C. for 24 h as described (Presta, L. G., et al., (1997) *Cancer Res.* 57, 4593-4599). Fab was purified with Protein G affinity chromatography. The production yield for Fab was typically 5-10 mg/L in small scale shake flask growth and 0.5-3 g/L in fermenter growth.

Binding kinetic values for the purified Fabs based on surface plasmon resonance are shown below. $hVEGF_{8-109}$ or mVEGF were immobilized on CM5 chips at ~100 response units in a BIAcore™-3000, as described previously (Chen, Y., et al., (1999) *J. Mol. Biol.* 293:865-881). Serial dilutions of Fab proteins (3-500 nM) were injected, and binding responses on the hVEGF or mVEGF flow cell were corrected by subtraction of responses on a blank flow cell. For kinetic analysis, a 1:1 Langmuir model with separate fittings of $k_{on}$ and $k_{off}$ was used. The $K_d$ values were estimated from the ratios of $k_{on}$ and $k_{off}$. All three Fabs bound with high affinity to hVEGF, but only two exhibited appreciable affinity for the highly homologous murine VEGF (mVEGF, 90% amino acid identity). We reasoned that YADS2 and YADS3 recognized VEGF through a very similar mechanism, as they exhibited high sequence homology in their CDRs and bound to both human and murine VEGF. In contrast, YADS1 likely represented a unique mode of antigen recognition as it contained very different CDR sequences and did not recognize mVEGF.

| | Kinetic analysis of Fabs binding to immobilized VEGF | | | | | |
|---|---|---|---|---|---|---|
| | $k_{on}$ (s$^{-1}$M$^{-1}$) | | $k_{off}$(s$^{-1}$) | | $K_d$ (nM) | |
| Fab | hVEGF | mVEGF | hVEGF | mVEGF | hVEGF | mVEGF |
| YADS 1 | $3 \times 10^5$ | ND[1] | $5 \times 10^{-4}$ | ND[1] | 1.8 ± 0.3 | >1000 |
| YADS 2 | $1 \times 10^6$ | $8 \times 10^5$ | $1 \times 10^{-2}$ | $4 \times 10^{-3}$ | 10 ± 2 | 5.0 ± 0.8 |
| YADS 3 | $1 \times 10^6$ | $2 \times 10^6$ | $3 \times 10^{-3}$ | $5 \times 10^{-3}$ | 2.0 ± 0.4 | 3.7 ± 0.6 |

[1]Values could not be determined due to the low affinity of the interaction.

Example 7

Crystallization, Structure Determination and Refinement of YADS1 and YADS2

We wanted to study the structural basis for antigen recognition, and so, the crystal structures of YADS1 and YADS2 in complex with hVEGF.

a. Fab Protein Preparation for Crystal Structure Analysis

Whole cell broth was obtained from a 10 liter *E. coli* fermentation. The cells were lysed with a Manton-Gaulin homogenizer. The suspension was centrifuged, the supernatant was loaded on a protein A-Sepharose column (Genentech, Inc.), and the column was eluted with 0.1 M acetic acid. The pH was adjusted to 4.0 with 1.0 M Tris, pH 8.0 and the eluant was loaded on a SP-Sepharose column (Pharmacia). The column was washed with equilibration buffer (20 mM MES, pH 5.5) and Fab protein was eluted with a NaCl gradient in equilibration buffer. Residues 8-109 of human VEGF were expressed, refolded, and purified as previously described (Christinger, H. W., et al., (1996). *Prot. Struct. Funct. Genet.* 26, 353-357).

The complex between each Fab and the receptor-binding fragment of hVEGF was formed and purified, as described previously (Muller, Y. A., (1998), supra). The complex (in PBS, 25 mM EDTA) was concentrated to an optical density of $A_{280}=10$. Hanging-drop experiments were performed using the vapor-diffusion method with 10 ul drops consisting of a 1:1 ratio of protein solution and reservoir solution. The reservoir solution for the YADS1 complex was 0.2 M ammonium sulfate, 25% PEG 3350 (w/v), 0.1 M HEPES, pH 7.5. The reservoir solution for the YADS2 complex was 1.0 M lithium chloride, 10% PEG 6000 (w/v), 0.1 M MES, pH 6.0. After 1-2 weeks at 19° C., plate or spindle shaped crystals grew for the YADS1 or YADS2 complex, respectively.

Crystals were incubated in reservoir solution supplemented with 25% glycerol prior to flash freezing. A data set was collected from a single frozen crystal at the beam line 5.0.2 of the Advanced Light Source (Berkeley) for YADS1 and at the beam line 9.2 of the Stanford Synchrotron Radiation Laboratory (Stanford University) for YADS2. The data was processed using the programs DENZO and SCALEPACK (Otwinowski, Z. M., (1997) *Methods Enzymol.* 276:307-326). The structures were solved by molecular replacement using the program AMoRe (CCP4 (1994) *Acta Cryst.* D50:760-763) and the coordinates of a previously solved Fab-hVEGF complex (PDB entry 1BJ1). The structure was refined using the programs REFMAC (CCP4 (1994), supra). The models were manually adjusted using program O (Jomes, T. A., et al., (1991) *Acta Crystallogra* A 47 (Pt2):969-995). The following programs were used to calculate the surface areas of interaction RESAREA version 3.2: Aug. 5, 1993 and AREAIMOL version 3.2: Dec. 19, 1995. These programs are part of the CCP4 suite Collaborative Computational Project, Number 4. 1994 ("The CCP4 Suite: Programs for Protein Crystallography" *Acta Cryst.* D50, 760-763). The crystal structures of YADS1 and YADS2 in complex with hVEGF were solved and refined at 2.65 and 2.8 Å resolution, respectively (Table 9).

TABLE 9

Data collection and refinement statistics for YADS1 and YADS2 hVEGF complexes.

| Space group | YADS 1 $P2_1$ | YADS 2 $C222_1$ |
|---|---|---|
| A. Unit cell | | |
| a (Å) | 83.3 | 96.5 |
| b (Å) | 112.5 | 149.6 |
| c (Å) | 105.8 | 117.4 |
| Beta (deg.) | 105.8 | |
| B. Diffraction Data | | |
| Resolution (Å) | 50-2.6 (2.7-2.6)$^a$ | 50-2.8 (2.9-2.8)$^a$ |
| No. of reflections | 156868 | 111731 |
| No. of unique reflections | 41828 | 20861 |
| $R_{merge}{}^b$ | 0.066 (0.356)$^a$ | 0.076 (0.399)$^a$ |
| Completeness (%) | 99.9 (99.1)$^a$ | 97.3 (83.2)$^a$ |
| C. Refinement | | |
| $R_{work}{}^c$, $R_{free}{}^c$ | 0.212, 0.271 | 0.218, 0.254 |
| No. of non-H atoms | 8104 | 4077 |
| No. of waters | 110 | 0 |
| rmsd bond length (Å) | 0.011 | 0.011 |
| rmsd angles (deg.) | 1.2 | 1.3 |

$^a$Values for the outer resolution shell are given in parantheses.
$^b R_{merge} = \Sigma_{hkl}|I_{hkl} - <I_{hkl}>|/\Sigma_{hkl} <I_{hkl}>$, where $I_{hkl}$ is the intensity of reflection hkl, and $<I_{hkl}>$ is the average intensity of multiple observations.
$^c R_{work} = \Sigma|F_o - F_c|/\Sigma F_o$, where $F_o$ and $F_c$ are the observed and calculated structure factor amplitudes, respectively. $R_{free}$ is the R factor for a randomly selected 5% of reflections which were not used in the refinement The surface area of each residue of an anti-VEGF antibody that is buried in VEGF (Å$^2$) is reported below together with the percentage of the total surface area of the residue that is buried. Also reported is the surface area of each residue of VEGF antibody that is buried in VEGF (Å$^2$) is reported below together with the percentage of the total surface area of the residue that is buried. See values for YADS-1:VEGF and YADS-2:VEGF complexes below. In all cases, because VEGF is a dimer, the residue numbers of VEGF referring to monomer 1 (of the VEGF dimer) are 8-109 and residue numbers of VEGF referring to monomer 2 (of the VEGF dimer) are 1008-1109. The first column in each table below recites the residue numbers of the protein being examined (either VEGF or an anti-VEGF antibody) (e.g., for section (a) below, TYR A 45 refers to Y45, LYS A1016 refers to K16 of VEGF). The second column recites the buried surface of that residue (Å$^2$). The third column recites the buried surface for that residue as a percentage of the surface area of the whole residue (a) VEGF:YADS-1

TABLE 10

Residues of VEGF in contact with YADS-1

| Residue Nr | buried surface | buried surface in % |
|---|---|---|
| TYR A 45 | 8.00 | 20.51% of 39.00 |
| ILE A 46 | 36.00 | 37.89% of 95.00 |
| LYS A 48 | 14.00 | 20.90% of 67.00 |
| GLN A 79 | 31.00 | 81.58% of 38.00 |
| MET A 81 | 24.00 | 75.00% of 32.00 |
| ARG A 82 | 7.00 | 14.58% of 48.00 |
| ILE A 83 | 33.00 | 76.74% of 43.00 |
| LYS A 84 | 25.00 | 40.98% of 61.00 |
| PRO A 85 | 8.00 | 14.55% of 55.00 |
| HIS A 86 | 107.00 | 54.04% of 198.00 |
| GLN A 87 | 110.00 | 71.43% of 154.00 |
| GLY A 88 | 38.00 | 95.00% of 40.00 |
| GLN A 89 | 103.00 | 88.79% of 116.00 |

TABLE 10-continued

Residues of VEGF in contact with YADS-1

| Residue Nr | buried surface | buried surface in % |
|---|---|---|
| HIS A 90 | 93.00 | 75.61% of 123.00 |
| ILE A 91 | 71.00 | 89.87% of 79.00 |
| GLY A 92 | 12.00 | 60.00% of 20.00 |
| GLU A 93 | 21.00 | 17.50% of 120.00 |
| LYS A 1016 | 31.00 | 25.20% of 123.00 |
| PHE A 1017 | 21.00 | 46.67% of 45.00 |
| MET A 1018 | 14.00 | 10.14% of 138.00 |
| ASN A 1062 | 10.00 | 28.57% of 35.00 |
| ASP A 1063 | 6.00 | 6.38% of 94.00 |
| GLU A 1064 | 89.00 | 49.17% of 181.00 |
| LYS A 1107 | 0.00 | 0.00% of 165.00 |

CHAIN A DIFF-AREA: 912.0 (8.16% of 11170.0 total AREA for this chain)
TOTAL DIFF-AREA: 912.0 (8.16% of 11170.0 total AREA over all chains)

(b) VEGF: YADS-2

TABLE 11

Residues of VEGF in contact with YADS-2

| Residue Nr | buried surface | buried surface in % |
|---|---|---|
| ILE A 46 | 6.00 | 8.82% of 68.00 |
| LYS A 48 | 39.00 | 60.94% of 64.00 |
| GLN A 79 | 17.00 | 45.95% of 37.00 |
| MET A 81 | 29.00 | 96.67% of 30.00 |
| ILE A 83 | 32.00 | 86.49% of 37.00 |
| PRO A 85 | 22.00 | 38.60% of 57.00 |
| HIS A 86 | 128.00 | 64.00% of 200.00 |
| GLN A 87 | 32.00 | 23.88% of 134.00 |
| GLY A 88 | 22.00 | 64.71% of 34.00 |
| GLN A 89 | 119.00 | 88.15% of 135.00 |
| HIS A 90 | 20.00 | 21.74% of 92.00 |
| ILE A 91 | 55.00 | 67.07% of 82.00 |
| LYS A 1016 | 1.00 | 0.87% of 115.00 |
| PHE A 1017 | 45.00 | 90.00% of 50.00 |
| MET A 1018 | 47.00 | 40.52% of 116.00 |
| TYR A 1021 | 7.00 | 8.97% of 78.00 |
| ASP A 1063 | 27.00 | 36.49% of 74.00 |
| GLY A 1065 | 6.00 | 13.33% of 45.00 |
| LEU A 1066 | 32.00 | 55.17% of 58.00 |
| CYS A 1104 | 3.00 | 12.50% of 24.00 |
| ARG A 1105 | 7.00 | 5.65% of 124.00 |
| PRO A 1106 | 29.00 | 37.66% of 77.00 |

CHAIN A DIFF-AREA: 725.0 (6.17% of 11744.0 total AREA for this chain).
TOTAL DIFF-AREA: 725.0 (6.17% of 11744.0 total AREA over all chains)

The residues having greater than 5 Å$^2$ buried surface area and/or greater than 5% buried were considered significantly contacted. These results help describe the regions in VEGF and the regions in the antibodies that contact one another. Together with functional data relating to the binding VEGF presented earlier, common features of the G6 series of antibodies YADS-2 and YADS-3 antibodies can be observed. The binding of antibodies such as Fab-12 and YADS-1 to VEGF resulted in the surface area of G88 being 100% and 95%, respectively, buried whereas the binding of G6, G6-23 and YADS-2 resulted in G88 being only 66% or less buried.

The Fab frameworks were essentially unchanged in comparison with the structure of the parental Fab4D5; the $C_\alpha$ atoms of the YADS1 and YADS2 frameworks superimposed with Fab4D5 with root mean square deviations (rmsd) of 0.87 and 0.55 Å, respectively. The Cα atoms of the hVEGF molecules in the two structures superimpose well onto each other with rmsds of 0.7 Å for 87 Cα positions. The largest deviation of 3.7 Å occurs at residue glutamic acid 64. The loop containing this residue has inherent flexibility as shown by Muller et al., supra.

In both complexes, antigen recognition was entirely mediated by contacts with the CDR loops. In terms of buried surface area, YADS1 used both the heavy (498 Å$^2$) and light chain (407 Å$^2$), whereas YADS2 used mostly the heavy chain (543 Å$^2$) and a small contribution from the light chain (157 Å$^2$). Notably, residues at randomized positions accounted for essentially all of the buried surface area (98% and 100% for YADS1 and YADS2, respectively), and furthermore, the buried surface area involved almost entirely side chain atoms (82% and 80% for YADS1 and YADS2, respectively). Thus, both Fabs bound to antigen through interactions that were almost entirely mediated by side chains located at positions that were randomized in the libraries.

On the hVEGF side, the structural epitopes for binding to YADS1 and YADS2 overlap with each other, and also, with the structural epitope for binding to domain 2 of the hVEGF receptor Flt-1 (Flt-1$_{D2}$). The YADS1 and YADS2 antibodies can inhibit binding of Flt to human VEGF in vitro (data not shown), and they are expected to inhibit binding of KDR to human VEGF too. Nonetheless, there are significant differences between the structural epitopes for the two Fabs. In particular, of the 11 residues that differ between human and murine VEGF, only residue 88 is in contact with the Fabs, but the interactions involving this residue explain the differing affinities of YADS1 and YADS2 for mVEGF. In the YADS2 complex, Gly88 is partially exposed to solvent, while in the YADS1 complex it is completely buried in the interface. Murine VEGF contains a larger serine residue at position 88; this substitution can be readily accommodated in the YADS2 complex, but in the YADS1 model, the introduction of a serine side chain at the buried Gly88 position would require major rearrangements for the complex to be preserved.

As described above, both Fabs bind to antigen through contacts almost exclusively involving side chains at varied sites. In total, the CDRs of YADS1 and YADS2 contain 66 residues derived from randomized codons, and these residues are almost equally distributed amongst the four amino acid types allowed in the library design. However, when we consider the subset of residues that make contact with antigen, there is a clear bias in that 16 tyrosines account for 50% of the contact residues. Indeed, all but two of the tyrosines selected in the CDRs of YADS1 and YADS2 make contact with antigen, and all told, tyrosines contribute 71% of the surface area buried upon complexation with hVEGF. Thus, essentially every selected tyrosine side chain is involved in directly mediating antigen recognition and the other selected amino acids apparently play auxiliary roles.

Despite the predominance of tyrosine in the synthetic antigen-binding sites, an examination of the heavy atom (non-hydrogen) content of buried surface areas reveals that the Fab-hVEGF interfaces are no more hydrophobic than the interface between hVEGF and Flt-1$_{D2}$. On the hVEGF side, the heavy atom composition of the buried surface area is very similar in all three cases, being composed predominantly of carbon but also containing significant proportions of nitrogen and oxygen. Within the buried surface areas of the Fabs, nitrogen atoms are almost entirely absent, because the side chains allowed in the libraries were composed entirely of carbon, oxygen and hydrogen. Nonetheless, both Fabs bury a large number of oxygen atoms upon binding to hVEGF, and in both cases, the proportion of the buried surface area contributed by carbon is considerably less than that contributed by carbon to the buried surface area of Flt-1$_{D2}$. Thus, the predominance of tyrosine in the synthetic CDRs does not produce highly hydrophobic Fab-antigen interfaces dominated by aromatic interactions. On the contrary, the tyrosine residues make specific contacts with a wide variety of residues on the hVEGF surface, and these interactions utilize both the side chain hydroxyl groups and aromatic rings.

Thus, we circumvented the complexity of the natural immune system by using precisely defined synthetic libraries, and as a result, we were able to investigate the special role that tyrosine plays in antigen-binding sites. We generated libraries with restricted diversities and displayed the diverse surfaces on a fixed scaffold formed by the framework regions and buried CDR residues. Our results dramatically demonstrate that, in the context of a suitable scaffold, the tyrosine side chain is capable of mediating most of the contacts necessary for high affinity antigen recognition. Thus, it seems very likely that the overabundance of tyrosine in natural antigen-binding sites is a consequence of the side chain being particularly well suited for making productive contacts with antigen.

This supposition is also consistent with the chemical nature of tyrosine. As noted previously, the tyrosine side chain is large enough to sweep out large volumes of space with only a few torsion angles, and it can form hydrogen bonds, hydrophobic interactions and attractive electrostatic interactions with positively charged groups (Zemlin, M., et al., (2003) *J. Mol. Biol.* 334:733-749). In addition, the uncharged tyrosine side chain avoids electrostatic repulsion effects, and its midrange hydrophilicity allows it to adapt favorably to both hydrophilic and hydrophobic environments (Zemlin, (2003), supra; Ivanov, I., et al., (2002) in *The Antibodies*, eds. Zanetti, M. & Capra, J. (Taylor & Fancis, London, New York), pp. 43-67; Mian, I. S., et al., (1991) *J. Mol. Biol.* 217:133-151).

We also observed that, while alanine and serine residues did not make many direct contacts with antigen, they allowed for space and conformational flexibility which may be crucial for appropriate positioning of the large tyrosine side chains. Thus, these small residues may serve an auxiliary function in facilitating productive contacts between tyrosine and antigen. It is worth noting that, perhaps not coincidentally, serine is also highly abundant in natural antigen-binding sites (Mian, (1991), supra). Finally, the paucity of antigen contacts mediated by aspartate suggests that it may be possible to further minimize the chemical diversity of these synthetic antigen-binding sites.

Example 8

Anti-VEGF Antibodies from YADS-A and YADS-B Libraries (a) Construction of Phage-Displayed Fab Libraries YADS-A and YADS-B Two phage displayed libraries (YADS-A and YADS-B) were constructed, as generally described in Example 6, with a previously described phagemid designed to display bivalent Fab moieties dimerized by a leucine zipper domain inserted between the Fab heavy chain and the C-terminal domain of the gene-3 minor coat protein (P3C), except that the following positions of 4D5 were randomized were randomized as follows:

| | | Randomized Positions | |
|---|---|---|---|
| Library | CDRH1 | CDRH2 | CDRH3 |
| YADS-A | 28, 30, 31, 32, 33 | 50, 52, 53, 54, 56, 58 | 95, 96, 97, 98, 99, 100, 100a |
| YADS-B | 28, 30, 31, 32, 33 | 50, 52, 53, 54, 56, 58 | 95, 96, 97, 98, 99, 100, 100a |

For library YADS-A, two separate mutagenesis reactions were performed. In the first reaction, diversity was introduced into CDR-H1, CDR H2 and CDR-H3 with oligonucleotides YADS-H1, YADS-H2 and YADS-H3-7, respectively. This resulted in the introduction of degenerate codons that encoded for the four amino acids tyrosine, alanine, aspartate, and serine (YADS). In the second reaction, diversity was introduced into CDR-H1, CDR H2 and CDR-H3 with oligonucleotides YTNS-H1, YTNS-H2 and YTNS-H3-7, respectively. This resulted in the introduction of degenerate codons that encoded for the four amino acids tyrosine, threonine, asparagine, and serine (YTNS). The two reactions were pooled.

For library YADS-B, 13 separate mutagenesis reactions were performed. The reactions resulted in the introduction of degenerate codons that encoded for the four amino acids tyrosine, alanine, aspartate, and serine (YADS). In each reaction, diversity was introduced into CDR-H1 and CDR-H2 with oligonucleotides YADS-H1 and YADS-H2. For each reaction, one of the following oligonucleotides was used to introduce diversity into CDR-H3: YADS-H3-3, YADS-H3-4, YADS-H3-5, YADS-H3-6, YADS-H3-7, YADS-H3-8, YADS-H3-9, YADS-H3-10, YADS-H3-11, YADS-H3-12, YADS-H3-13, YADS-H3-14, or YADS-H3-15. The 13 reactions were pooled.

For both libraries, the pooled mutagenesis reactions were electroporated in *E. coli* SS320 (Sidhu et al., supra). The transformed cells were grown overnight in the presence of M13-KO7 helper phage (New England Biolabs, Beverly, Mass.) to produce phage particles that encapsulated the phagemid DNA and displayed Fab fragments on their surfaces. The size of libraries YADS-A and YADS-B were both 7×10$^9$.

(b) Selection of Anti-hVEGF Specific Antibodies from YADS-A and YADS-B Naïve Libraries Phage from library YADS-A and YADS-B were cycled separately through rounds of binding selection to enrich for clones binding to h-VEGF. The binding selections were conducted using previously described methods (Sidhu et al., supra).

NUNC 96-well Maxisorp immunoplates were coated overnight at 4° C. with capture target (5 µg/mL) and blocked for 2 h with BSA (Sigma). After overnight growth at 37° C., phage were concentrated by precipitation with PEG/NaCl and resuspended in PBS, 0.5% BSA, 0.05% Tween 20 (Sigma), as described previously (Sidhu et al., supra). Phage solutions (~10$^{12}$ phage/mL) were added to the coated immunoplates. Following a 2 h incubation to allow for phage binding, the plates were washed 10 times with PBS, 0.05% Tween20. Bound phages were eluted with 0.1 M HCl for 10 min and the eluant was neutralized with 1.0 M Tris base. Eluted phage were amplified in *E. coli* XL1-blue and used for further rounds of selection.

The libraries were subjected to 4 rounds of selection against each target protein. Individual clones from each round were grown in a 96-well format in 500 μL of 2YT broth supplemented with carbenicillin and M13-VCS, and the culture supernatants were used directly in phage ELISAs (Sidhu et al., supra) to detect phage-displayed Fabs that bound to plates coated with target protein but not to plates coated with BSA. A clone was considered to be a specific binder if the ELISA signal on target coated plates was at least 20 times greater than that on BSA coated plates.

Specific binders were sequenced, and the sequences of unique clones are shown in FIGS. 37 and 38 for libraries YADS-A and YADS-B, respectively. Sequences from FIG. 37 were obtained by sorting with human VEGF8-109. Sequences from FIG. 38 were obtained by sorting with murine VEGF.

Example 9

NNK Variants of YADS2

(a) Construction of phage-displayed Fab libraries by randomizing selected positions of the YADS2 anti-VEGF antibody with the NNK codon Phage-displayed Fab libraries were constructed using a phagemid vector that resulted in the display of bivalent Fab moieties dimerized by a leucine zipper domain inserted between the Fab heavy chain and the C-terminal domain of the gene-3 minor coat protein (P3C). This vector comprised the YADS2 sequence. The humanized antibody YADS2 variable domains were expressed under the control of the IPTG-inducible Ptac promoter.

Library NNK was constructed with randomized residues in the heavy chain CDR-3 of YADS2. The specific residues that were randomized are 50, 95, 97, 99, 100, and 100a of the heavy chain.

At each of the randomized positions, the wild-type codon was replaced by a degenerate NNK codon (N=A/T/G/C, K=G/T in an equimolar ratio) that encoded for all 20 natural amino acids.

Libraries were constructed using the method of Kunkel (Kunkel, T. A., Roberts, J. D. & Zakour, R. A., *Methods Enzynmol.* (1987), 154, 367-382) with previously described methods (Sidhu, S. S., Lowman, H. B., Cunningham, B. C. & Wells, J. A., *Methods Enzymol.* (2000), 328, 333-363). A unique "stop template" version of the Fab display vector was used to generate the NNK library. We used a template phagemid bearing the gene coding for YADS2 fab with TAA stop codons inserted at positions 30, 33, 52, 54, 56, 57, 60, 102, 103, 104, 107, 108 of the heavy chain. Mutagenic oligonucleotides with degenerate NNK codons at the positions to be diversified were used to simultaneously introduce CDR diversity and repair the stop codons. Diversity was introduced into CDR-H3 with the oligonucleotide named NNK-H1 (GCA GCT TCT GGC TTC GCT ATT TAT GAT TAT GAT ATA CAC TGG GTG CGT (SEQ ID NO:25)), NNK-H2 (CTG GAA TGG GTT GCA NNK ATT GCT CCA TAT GCT GGT GCT ACT GCT TAT GCC GAT AGC GTC (SEQ ID NO:26)) and NNK-H3 GTC TAT TAT TGT AGC CGC NNK TCT NNK GCT NNK NNK NNK GCT ATG GAC TAC TGG (SEQ ID NO:27)). The mutagenic oligonucleotides for all three heavy chain CDRs were incorporated simultaneously in a single mutagenesis reaction, so that so that simultaneous incorporation of the mutagenic oligonucleotide resulted in the introduction of the designed diversity at each position and simultaneously repaired all the TAA stop codons, thus generating an open reading frame that encoded a Fab library member fused to a homodimerizing leucine zipper and P3C. Note that the oligonucleotide NNK-H1 does not contain any degenerate codon and is added to the mutagenesis reaction to repair the TAA stop codons and introduce the wild type YADS2 sequence.

The mutagenesis reactions were electroporated into *E. coli* SS320 (Sidhu et al., supra), and the transformed cells were grown overnight in the presence of M13-KO7 helper phage (New England Biolabs, Beverly, Mass.) to produce phage particles that encapsulated the phagemid DNA and displayed Fab fragments on their surfaces. Each library contained greater than $5 \times 10^9$ unique members.

(b) Selection of Specific Anti-VEGF Antibodies from the NNK Library

Phage from library NNK were cycled through rounds of binding selection to enrich for clones binding to human VEGF. The binding selections were conducted using previously described methods (Sidhu et al., supra).

NUNC 96-well Maxisorp immunoplates were coated overnight at 4° C. with capture target (5 μg/mL) and blocked for 2 h with Superblock TBS (tris-buffered saline) (Pierce). After overnight growth at 37° C., phage were concentrated by precipitation with PEG/NaCl and resuspended in Superblock TBS, 0.05% Tween 20 (Sigma), as described previously (Sidhu et al., supra). Phage solutions (~$10^{12}$ phage/mL) were added to the coated immunoplates. Following a 2 h incubation to allow for phage binding, the plates were washed 10 times with PBS, 0.05% Tween 20. Bound phage were eluted with 0.1 M HCl for 10 min and the eluant was neutralized with 1.0 M Tris base. Eluted phage were amplified in *E. coli* XL1-blue and used for further rounds of selection.

The libraries were subjected to 5 rounds of selection against VEGF. Individual clones from each round of selection were grown in a 96-well format in 500 μL of 2YT broth supplemented with carbenicillin and M13-VCS, and the culture supernatants were used directly in phage ELISAs (Sidhu et al., supra) to detect phage-displayed Fabs that bound to plates coated with target protein but not to plates coated with BSA. Specific binders were defined as those phage clones that exhibited an ELISA signal at least 15-fold greater on target-coated plates in comparison with BSA-coated plates. Individual clones were screened after 3 to 5 rounds of selection for VEGF binding.

Individual clones representing specific binders were subjected to DNA sequence analysis, and the sequences of the randomized CDR positions are shown in FIG. 40. The affinity of the different YADS variants was estimated by using a "two point competitive phage ELISA". The three best clones were produced as soluble Fab and were tested for their affinity with respect to hVEGF. BIAcore data was obtained according to Chen et al., *J. Mol Biol.* (1999), 293(4):865-81. Briefly, binding affinities were calculated from association and dissociation rate constants measured using a BIAcore™-3000 surface plasmon resonance system (BIAcore, Inc., Piscataway, N.J.). A biosensor chip was activated for covalent coupling of VEGF using N-ethyl-N'-(3-dimethylaminopropyl)-carbodiimide hydrochloride (EDC) and N-hydroxysuccinimide (NHS) according to the supplier's (BIAcore, Inc., Piscataway, N.J.) instructions. hVEGF or mVEGF was buffer-exchanged into 10 mM sodium acetate, pH 4.8 and diluted to approximately 30 mg/ml. Aliquots of VEGF were injected at a flow rate of 2 microL/minute to achieve approximately 200-300 response units (RU) of coupled protein. A solution of 1 M ethanolamine was injected as a blocking agent. For kinetics measurements, twofold serial dilutions of Fab were injected in PBS/Tween buffer (0.05% Tween20 in phosphate-buffered saline) at 25° C. at a flow rate of 10 microL/minute. Equilibrium dissociation constants, Kd values from surface plasmon resonance measurements were calculated as $k_{off}/k_{on}$. The BIAcore™ data is summarized as follows:

| Clone Name | hVEGF (nM) | mVEGF (nM) |
|---|---|---|
| NNK-1 | 0.60 | 0.24 |
| NNK-2 | 2.0 | 13 |
| NNK-3 | 6.0 | |

Example 10

Binomial Diversity Libraries (a) Construction of Phage-Displayed Fab Libraries with CDR Residues Randomized as Only Tyr or Ser Phage-displayed Fab libraries were constructed using a phagemid vector that resulted in the display of bivalent Fab moieties dimerized by a leucine zipper domain inserted between the Fab heavy chain and the C-terminal domain of the gene-3 minor coat protein (P3C). This vector comprises the humanized antibody 4D5 variable domains under the control of the IPTG-inducible Ptac promoter as described above. The humanized antibody 4D5 is an antibody which has mostly human consensus sequence framework regions in the heavy and light chains, and CDR regions from a mouse monoclonal antibody specific for Her-2. The method of making the anti-Her-2 antibody and the identity of the variable domain sequences are provided in U.S. Pat. Nos. 5,821,337 and 6,054,297.

Two libraries were constructed. Library YS-A was constructed with randomized residues in all three heavy chain CDRs, while Library YS-B was constructed with randomized residues in all three heavy chain CDRs and light chain CDR3. The specific residues that were randomized are shown below.

| | | Randomized Positions | | |
|---|---|---|---|---|
| Library | CDRL3 | CDRH1 | CDRH2 | CDRH3 |
| YS-A | | 28, 30, 31, 32, 33 | 50, 52, 53, 54, 56, 58 | 95, 96, 97, 98, 99, 100, 100a |
| YS-B | 91-94, 96 | 28, 30, 31, 32, 33 | 50, 52, 53, 54, 56, 58 | 95, 96, 97, 98, 99, 100, 100a |

At each of the randomized positions, the wild-type codon was replaced by a degenerate TMT codon (M=A/C in an equimolar ratio) that encoded for Tyr and Ser in an equimolar ratio. In addition, the length of CDRH-3 was varied by using oligonucleotides that replaced the 7 wild-type codons between positions 101 to 107 with varying numbers of TMT codons (7 to 20 for Library YS-A and 7 to 15 for Library YS-B). In addition, the CDRL3 of Library YS-B was randomized so that 50% of the library members contained a deletion at position number 91 while the other 50% contained the wildtype Gln residue at this position.

Libraries were constructed using the method of Kunkel (Kunkel, T. A., Roberts, J. D. & Zakour, R. A., *Methods Enzymol.* (1987), 154, 367-382) with previously described methods (Sidhu, S. S., Lowman, H. B., Cunningham, B. C. & Wells, J. A., *Methods Enzymol.* (2000), 328, 333-363). A unique "stop template" version of the Fab display vector was used to generate both libraries YS-A and YS-B. We used a template phagemid designated pV0350-4 with TAA stop codons inserted at positions 30, 33, 52, 54, 56, 57, 60, 102, 103, 104, 107, 108 of the heavy chain. No stops were introduced in the light chain CDR3. Mutagenic oligonucleotides with degenerate TMT codons at the positions to be diversified were used to simultaneously introduce CDR diversity and repair the stop codons. For both libraries, diversity was introduced into CDR-H1 and CDR-H2 with oligonucleotides H1 and H2, respectively. For Library YS-A, diversity was introduced into CDR-H3 with an equimolar mixture of oligonucleotides. For library YS-B, diversity was introduced into CDR-H3 with an equimolar mixture of oligonucleotides. For library YS-B, diversity was introduced into CDR-L3 with an equimolar mixture of oligonucleotides. The mutagenic oligonucleotides for all CDRs to be randomized were incorporated simultaneously in a single mutagenesis reaction, so that simultaneous incorporation of all the mutagenic oligonucleotides resulted in the introduction of the designed diversity at each position and simultaneously repaired all the TAA stop codons, thus generating an open reading frame that encoded a Fab library member fused to a homodimerizing leucine zipper and P3C.

The mutagenesis reactions were electroporated into *E. coli* SS320 (Sidhu et al., supra), and the transformed cells were grown overnight in the presence of M13-KO7 helper phage (New England Biolabs, Beverly, Mass.) to produce phage particles that encapsulated the phagemid DNA and displayed Fab fragments on their surfaces. Each library contained greater than $5 \times 10^9$ unique members.

(b) Selection of Specific Antibodies from the Naïve Libraries YS-A and YS-B

Phage from library YS-A or YS-B were cycled through rounds of binding selection to enrich for clones binding to targets of interest. Target proteins, human $VEGF_{8-109}$ and murine VEGF were analyzed separately with each library. The binding selections were conducted using previously described methods (Sidhu et al., supra).

NUNC 96-well Maxisorp immunoplates were coated overnight at 4° C. with capture target (5 μg/mL) and blocked for 2 h with Superblock TBS (tris-buffered saline) (Pierce). After overnight growth at 37° C., phage were concentrated by precipitation with PEG/NaCl and resuspended in Superblock TBS, 0.05% Tween 20 (Sigma), as described previously (Sidhu et al., supra). Phage solutions (~$10^{12}$ phage/mL) were added to the coated immunoplates. Following a 2 h incubation to allow for phage binding, the plates were washed 10 times with PBS, 0.05% Tween 20. Bound phage were eluted with 0.1 M HCl for 10 min and the eluant was neutralized with 1.0 M Tris base. Eluted phage were amplified in *E. coli* XL1-blue and used for further rounds of selection.

The libraries were subjected to 5 rounds of selection against each target protein, and at each round, titers were obtained for phage binding to either the target protein or blank wells coated with Superblock TBS. The titer of phage bound to target-coated wells divided by the titer of phage bound to the blank wells was defined as an enrichment ratio used to quantify specific binding of phage pools to the target protein; larger enrichment ratios indicate higher specific binding. The enrichment ratios were observed after 3, 4, or 5 rounds of selection.

Individual clones from each round of selection were grown in a 96-well format in 500 μL of 2YT broth supplemented with carbenicillin and M13-VCS, and the culture supernatants were used directly in phage ELISAs (Sidhu et al., supra) to detect phage-displayed Fabs that bound to plates coated with target protein but not to plates coated with BSA. Specific binders were defined as those phage clones that exhibited an ELISA signal at least 15-fold greater on target-coated plates in comparison with BSA-coated plates. Individual clones were screened after 2 rounds of selection for binding to human VEGF or after 5 rounds of selection for the other target proteins. These data were used to calculate the percentage of specific binders, and the results for each library against each target protein. Each library produced binders against each target protein.

Individual clones representing specific binders were subjected to DNA sequence analysis, and the sequences of the randomized CDR positions are shown in FIG. 41. It can be seen that, for each target protein, it was possible to select specific binders that contained only Tyr or Ser at the randomized positions (although some non-designed mutations were observed, which were likely created during library construction probably due to impurities in the oligonucleotides). Furthermore, the sequences of specific binders were unique to the target protein against which they were selected.

Two of the binders listed in FIG. 41 (hVEGF binder #3 and #18) were tested for their affinity with respect to hVEGF and mVEGF. BIAcore data was obtained according to Chen et al., J. Mol. Biol. (1999), 293(4):865-81. Briefly, binding affinities of hVEGF binder #3 and #18 for hVEGF and mVEGF were calculated from association and dissociation rate constants measured using a BIAcore™-2000 surface plasmon resonance system (BIAcore, Inc., Piscataway, N.J.). A biosensor chip was activated for covalent coupling of VEGF using N-ethyl-N'-(3-dimethylaminopropyl)-carbodiimide hydrochloride (EDC) and N-hydroxysuccinimide (NHS) according to the supplier's (BIAcore, Inc., Piscataway, N.J.) instructions. hVEGF or mVEGF was buffer-exchanged into 10 mM sodium acetate, pH 4.8 and diluted to approximately 30 mg/ml. Aliquots of VEGF were injected at a flow rate of 2 microL/minute to achieve approximately 200-300 response units (RU) of coupled protein. A solution of 1 M ethanolamine was injected as a blocking agent. For kinetics measurements, twofold serial dilutions of Fab were injected in PBS/Tween buffer (0.05% Tween20 in phosphate-buffered saline) at 25° C. at a flow rate of 10 microL/minute. Equilibrium dissociation constants, Kd values from surface plasmon resonance measurements were calculated as $k_{off}/k_{on}$. The BIAcore™ data is summarized below

|  | hVEGF coated on the chip | mVEGF coated on the chip |
|---|---|---|
| Clone #3 |  |  |
| $k_a$ ($M^{-1} \cdot s^{-1}$) (on-rate) | $1.6 \times 10^6$ | Not detectable |
| $k_d$ ($s^{-1}$) (off-rate) | $7 \times 10^{-2}$ | Not detectable |
| Kd | 46 +/− 17 nM | Not detectable (>1 uM) |
| Clone #18 |  |  |
| $k_a$ ($M^{-1} \cdot s^{-1}$) (on-rate) | $1 \times 10^5$ | $4 \times 10^4$ |
| $k_d$ ($s^{-1}$) (off-rate) | $8 \times 10^{-3}$ | $2 \times 10^{-2}$ |
| Kd | 64 +/− 7 nM | 600 +/− 200 nM |

Example 11

Additional Anti-VEGF YS Antibodies

Library construction and sorting. A phagemid designed to display bivalent Fab4D5 on the surface of M13 bacteriophage was used to construct libraries, as described above. Oligonucleotide-directed mutagenesis was used to replace CDR positions with TMT degenerate codons, (M=A/C in equal proportions). The positions chosen for randomization were as follows:

| Library | Randomized Positions | | | |
|---|---|---|---|---|
|  | CDRL3 | CDRH1 | CDRH2 | CDRH3 |
| YS-A |  | 28, 30, 31, 32, 33 | 50, 52, 53, 54, 56, 58 | 95-100 replaced with 7-20 residues |
| YS-B | 91-94, 96 | 28, 30, 31, 32, 33 | 50, 52, 53, 54, 56, 58 | 95-100a replaced with 7-15 residues. |

In CDR-H3, positions 95 through 100a were replaced with random loops of all possible lengths ranging from 7 to 20 residues (library A) or 7 to 15 residues (library B). Each library contained ~$10^{10}$ unique members, and thus, the actual library diversities were comparable to the maximum number of unique sequences encoded by the library designs ($4 \times 10^9$).

Phage from the libraries were cycled through rounds of binding selection with antigen immobilized on 96-well Maxisorp immunoplates (NUNC) as the capture target, as described previously (Sidhu, S. S., et al., (2000) Methods Enzymol. 328:333-363). After five rounds of selection, phage were produced from individual clones grown in a 96-well format and the culture supernatants were used in phage ELISAs to detect specific binding clones. Specific binding clones were determined to be Fab-phage that bound to the cognate antigen but did not exhibit detectable binding to seven other proteins.

Competitive phage ELISA. A modified phage ELISA was used to estimate the binding affinities of Fabs (Sidhu, (2000), supra; Deshayes, K., et al., (2002) Chem. Biol. 9:495-505). Phage ELISAs were carried out on plates coated with antigen, as described above. Phage displaying antibody fragments were serially diluted in PBS, 0.5% (w/v) BSA, 0.1% (v/v) Tween 20, and binding was measured to determine a phage concentration giving ~50% of the signal at saturation. A fixed, sub-saturating concentration of phage was preincubated for 2 hours with serial dilutions of antigen and then transferred to assay plates coated with antigen. After 15 minutes incubation, the plates were washed with PBS, 0.05% Tween 20 and incubated 30 minutes with horseradish peroxidase/anti-M13 antibody conjugate (1:5000 dilution) (Pharmacia). The plates were washed, developed with TMB substrate (Kirkegaard and Perry Laboratories), quenched with 1.0 M $H_3PO_4$, and read spectrophotometrically at 450 nm. The binding affinities of the Fabs were determined as $IC_{50}$ values defined as the concentration of antigen that blocked 50% of the phage binding to the immobilized antigen. DNA sequencing of 184 binding clones revealed 63 unique sequences shown in FIG. 42. Interestingly, the clones from library B exhibit homology within the selected CDR-L3 and CDR-H3 sequences. In contrast, the CDR-H3 sequences of the clones from library A exhibit homology amongst themselves but are very different from the sequences from library B. Thus, it appears that the nature of the CDR-L3 sequence influenced the selection of CDR-H3 sequences, and as a result, two distinct classes of anti-hVEGF antibodies arose from the two different libraries. The clones were screened by competitive phage ELISA and exhibited $IC_{50}$ values ranging from approximately 60 nM to greater than 5 μM.

Protein purification and affinity analysis. The three anti-hVEGF clones with the highest estimated affinities (top three sequences in FIG. 42) were purified as free Fab proteins. Fab proteins were purified from *E. coli* as described previously (Muler, Y. A., et al., (1998) *Structure* 6:1153-1167). See FIG. 43 for YS1 Fab sequence. The binding kinetics of the purified Fabs (designated Fab-YS1, Fab-YS2 and Fab-YS3) were studied by surface plasmon resonance. Binding kinetics were determined by surface plasmon resonance using a BIAcore™M-3000 with hVEGF immobilized on CM5 chips at ~500 response units, as described previously (Chen, Y., et al., (1999) *J. Mol. Biol* 293:865-881). Serial dilutions of Fab proteins were injected, and binding responses were corrected by subtraction of responses on a blank flow cell. For kinetic analysis, a 1:1 Langmuir model of global fittings of $k_{on}$ and $k_{off}$ was used. The $K_d$ values were determined from the ratios of $k_{on}$ and $k_{off}$.

|  | YS1 | YS2 | YS3 |
|---|---|---|---|
| $k_a$ ($10^4 \cdot M_{-1} \cdot s^{-1}$) | 5 ± 1 | 6 ± 1 | 5 ± 1 |
| kd ($10^{-3} \cdot s^{-1}$) | 2.8 ± 0.1 | 11.7 ± 0.4 | 9.4 ± 0.1 |
| $K_D$ (nM) | 60 ± 20 | 220 ± 60 | 190 ± 40 |

Fab-YS1 exhibited the highest affinity for hVEGF ($K_d$=60 nM), while the other two Fabs bound approximately 5-fold less tightly due to faster off rates. The sequences of Fab-YS1 and Fab-YS2 differ in only three positions, and thus, these three differences account for the improved affinity of Fab-YS1 in comparison with Fab-YS2.

Immunohistochemistry. We next investigated the specificity of Fab-YS1 by using the protein to visualize VEGF in mammalian cells transfected with a gene encoding for VEGF fused to green fluorescent protein (GFP). Human A673 cells expressing murine VEGF-GFP were stained and imaged, as described (Peden, A. A., et al., (2004) *J. Cell. Biol.* 164:1065-1076). In the plus VEGF panel, Fab-YS1 was pre-incubated for 5 minutes with a 5-fold excess of recombinant VEGF before being incubated with the cells. The immunohistochemical staining with Fab-YS1 precisely overlapped with the fluorescence signal from the VEGF-GFP fusion (data not shown). Furthermore, the signal was completely blocked by incubating Fab-YS1 with hVEGF prior to the staining.

Immunoprecipitation. We also conducted immunoprecipitations of endogenous hVEGF and compared the performance of Fab-YS1 to that of a highly specific, natural anti-hVEGF monoclonal antibody (A4.6.1) (Kim, K. J., et al., (1992) *Growth Factors* 7:53-64). A673 cells were metabolically labelled and immunoprecipitations were performed from the media, as described (Kim, K. J., et al., supra) using 15 ug of anti-GFP polyclonal antibody (Clontech), Fab-YS1 or monoclonal antibody A4.6.1. The immune complexes were eluted by boiling and resolved by SDS-PAGE on a 14% acrylamide gel under reducing conditions. The gel was dried and then exposed to a phosphoimager plate overnight. Both antibodies immunoprecipitated an identical set of bands that likely represent hVEGF variants generated by alternative mRNA splicing (data not shown). Taken together, these results show that Fab-YS1 binds to hVEGF with high affinity and specificity comparable to that of a natural antibody, even in the complex cellular milieu.

Example 12

In vivo Activities of the Anti-VEGF Antibodies

Figure 10A:
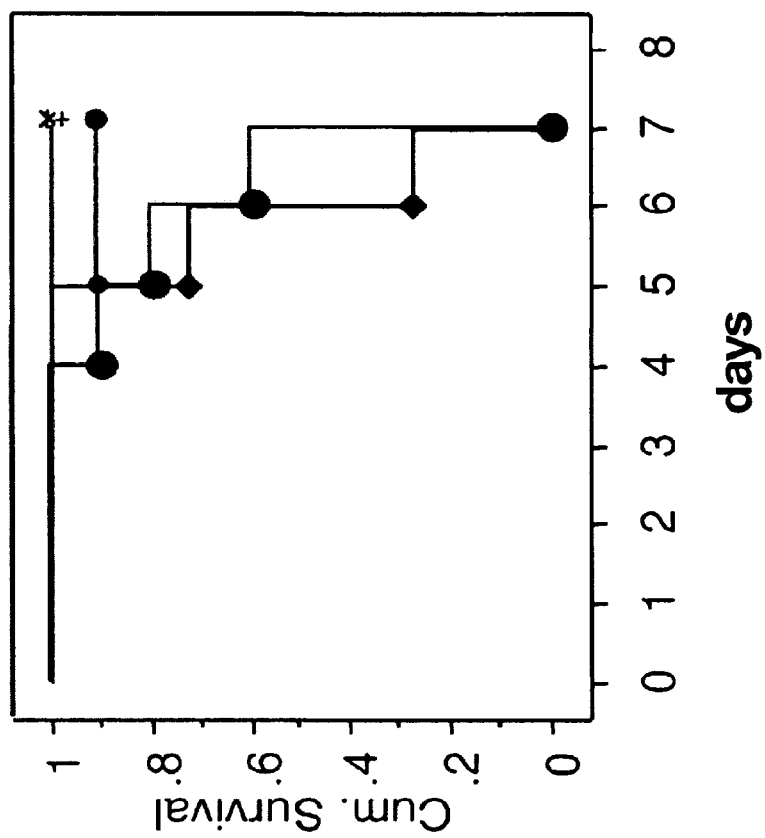
FIG. 10 depicts effects of VEGF antagonists (G6-23 and Flt1-3Fc) on neonate mice body weights and survival rates.
Figure 10B:
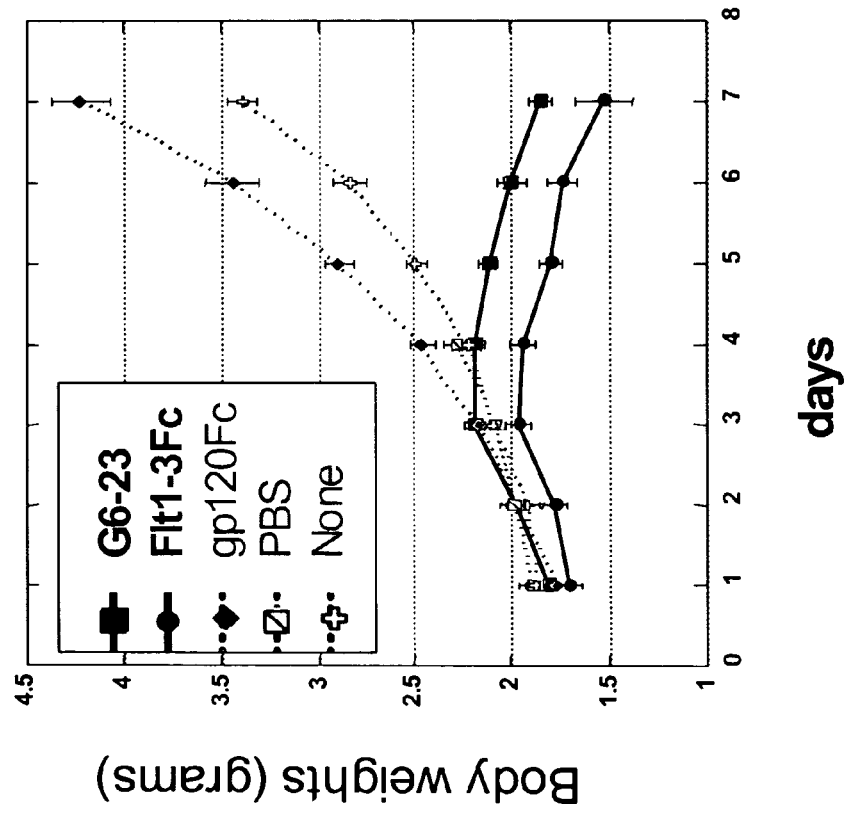

G6-23 inhibits neonate mouse growth and survival. Newborn mice (C57/BL6) were intra-peritoneally (i.p.) injected daily at 1 day post-natally with G6-23 IgG (50 mg/kg) or Flt-1(1-3) Fe (50 mg/kg), or appropriate controls, gp120-Fc, PBS or no injection. The body weights were measured daily and the survival rate of the mice were counted. As shown in FIG. 10, G6-23 reduced body weight equal potently as mFlt-1(1-3)Fc, which is a known mVEGF antagonist. Moreover, mouse survival rates were also equivalent between the two groups. Significantly, the results of G6-23 specifically indicated that mVEGF is required for the growth and survival of new born mice, whereas the effect of Flt-1(1-3) Fc is less specific since it is known to block not only mVEGF, but also placental growth factor (PlGF) and VEGF-B.

Figure 11B:
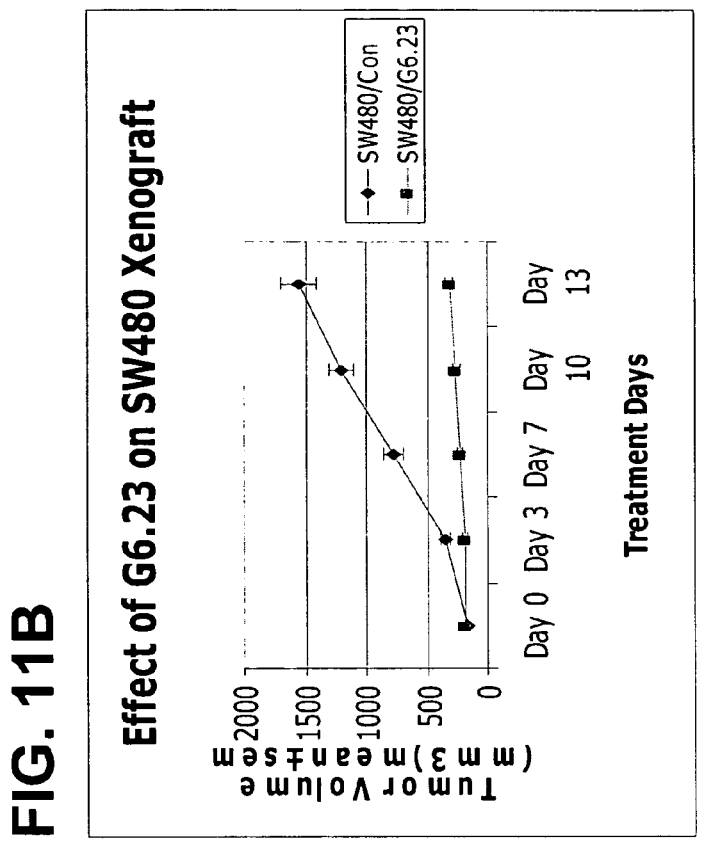
FIG. 11 depicts effects of G6-23 on tumor growth in nude mice with xenografted human tumor cells (KM12 cells and SW480 cells), as measured by tumor volumes over number of treatment days.
Figure 11A:
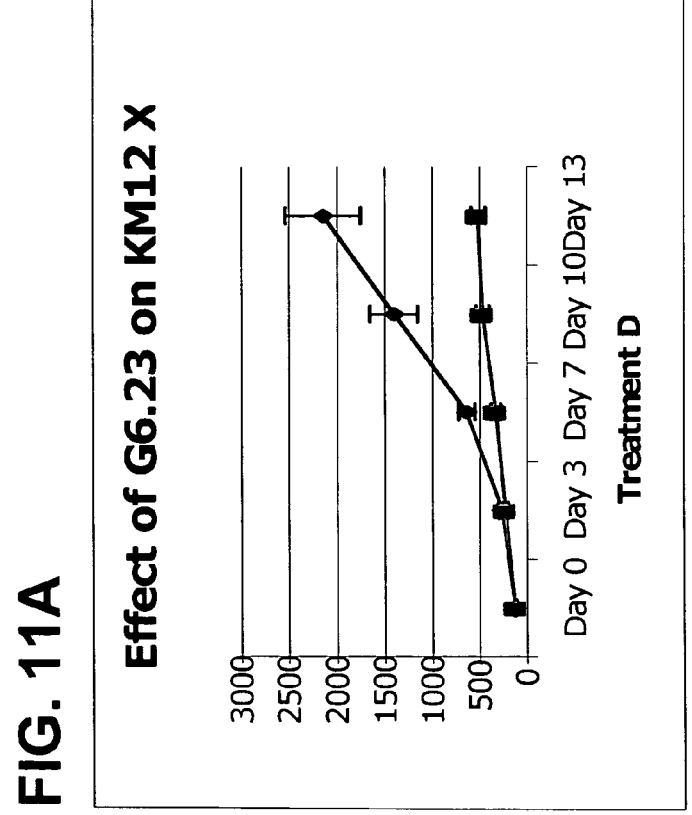

G6-23 effectively inhibits the growth of xenograft tumors in nude mice. KM12 and SW480, two human colon-rectal cancer cell lines, were grown in cell culture first and about $10^6$ cells from each cell line were injected into host nude mice. When the tumor reached approximately 100 mm$^3$ in size (1 week after injection), G6-23 or control were injected (10 mg/kg) twice weekly (six nude mice were used for each group). The tumor sizes were measured till day 13 after antibody injection. As shown in FIG. 11, G6-23 was significantly effective in reducing tumor volumes of both KM12 (left graph) and SW480 (right graph) cell lines.

Figure 12A:
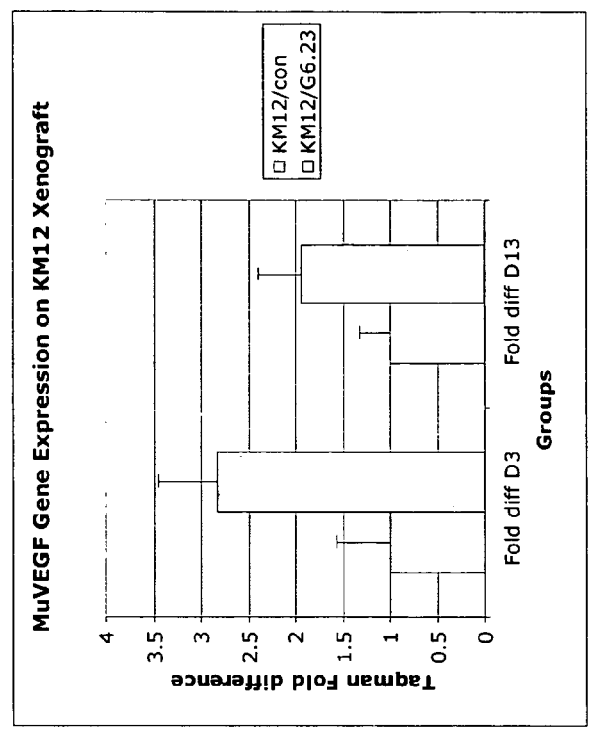
FIG. 12 shows VEGF expressions (both hVEGF and mVEGF) in KM12 xenograft mice in the presence or absence of G6-23.
Figure 12B:
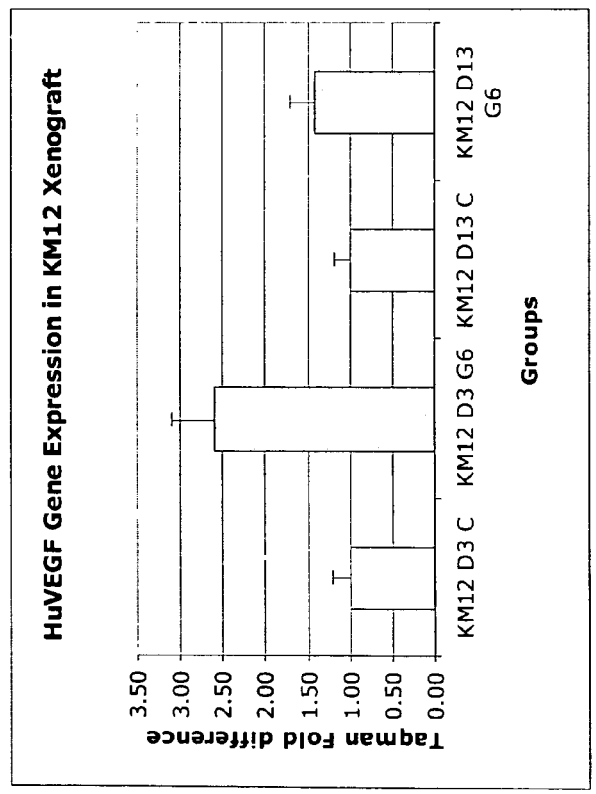

Gene expressions for both hVEGF and mVEGF were examined in KM12 xenograft mice. Samples of tumors and surrounding tissues were extracted and Tagman was used to quantify the gene expression levels. In these xenograft models, hVEGF came from the implanted human KM12 tumor cells, whereas mVEGF came from surrounding host stromal cells. As shown in FIG. 12, samples from mice treated with G6-23 on day 3 and day 13 had higher gene expression levels for both hVEGF and mVEGF compared to the control groups. The results indicate that while mouse treated with G6-23 had reduced tumor growth and much decreased vascularity, expressions of both mVEGF and hVEGF were up-regulated in response to the reduction of angiogenesis. It also indicates that at the tumor site, there is significant infiltration of mouse stromal cells, which is a major source of VEGF for the tumor angiogenesis. Therefore, in a preclinical animal model such as the xenograft model described herein, an antibody capable of cross-reacting and blocking both hVEGF and mVEGF is necessary for studying its efficacy.

Figure 13:
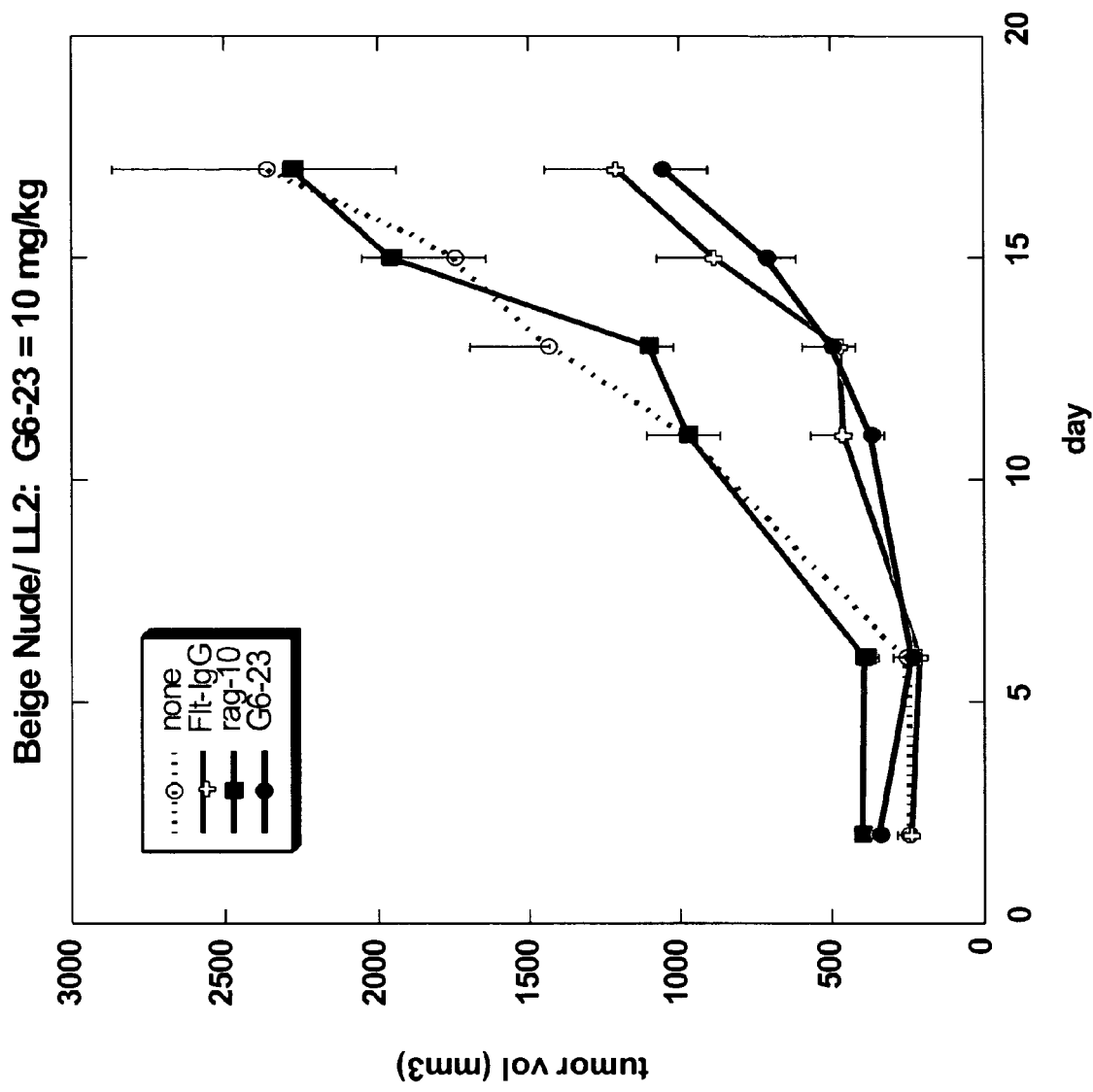
FIG. 13 depicts effects of VEGF antagonists (G6-23 and Flt1-3Fc) on tumor growth in nude mice with xenografted mouse tumor (LL2), as measured by tumor volumes over number of treatment days.

Mouse (Lewis) lung carcinoma (LL2) cells were also used in a nude mice model to test the inhibitory effect of G6-23. About $10^6$ cells LL2 cells in a matrigel formulation were administered subcutaneously in the flank of 5-week old beige nude mice. One group of six mice were then treated with G6-23 at 10 mg/kg, injected via i.p. twice weekly for a span of 19 days. Other control agents (i.e., mFlt(1-3)-IgG, rag-10) were also used to treat groups of six mice. As shown in FIG. 13, G6-23 significantly reduced the rate of tumor growth with a pharmacological effect comparable to that of mFlt(1-3)-IgG, which is known to be multi-potent in blocking not only mVEGF, but also other angiogenic factors mPlGF and mVEGF-B. Serum levels of bioactive G6-23 was also measured. The result indicates that its levels (62-121 ug/ml) are well within the expected range for a therapeutic neutralizing anti-VEGF antibody.

HM-7 cells (American Type Culture Collection) were also used to study the tumor growth inhibition in nude mice. G6 IgG antibody, G6-31 IgG antibody, the Avastin™ antibody, the Y0317 IgG antibody used in this study were expressed in and purified from CHO cells. HM-7 cells were maintained in culture with F12:DMEM medium, supplemented with 10% FBS and 1% penicillin-streptomycin and 1% Glutamine. Cells were grown at 37° C. in 5% CO2 until confluence, harvested, counted, and washed and resuspended in sterile Metrigel at a concentration of $25 \times 10^6$ cells per ml. Xenografts were established in 4- to 6-week-old female Beige Nude XID mice by injecting $5 \times 10^6$ of HM-7 cultured cells into the dorsal flank of the mice and allowed to grow. After 48 hours, the tumors were palpable in all mice, and cohorts were randomly selected (n=10) to provide day-0 controls. The remaining mice were divided into 23 groups and injected twice weekly with different anti-VEGF antibodies. The treatments for the study groups are as follows: Group A (n=10×1): mice treated with control antibody MAB (an anti-ragweed antibody) in 0.1 ml by interperitoneal injection twice/week with a high dose (5 mg/kg). Group B (n=10×5): mice treated with G6 IgG antibody in 0.1 ml by interperitoneal injection twice/week with the same dose (0.1, 0.25, 0.5, 2 or 5 mg/kg). Group C (n=10× 5): mice treated with Y0317 IgG antibody in 0.1 ml by interperitoneal injection twice/week with the same dose (0.1, 0.25, 0.5, 2 or 5 mg/kg). Group D (n=10×5): mice treated with the Avastin™ antibody in 0.1 ml by interperitoneal injection twice/week with the same dose (0.1, 0.25, 0.5, 2 or 5 mg/kg). Group E (n=10×5): mice treated with G6-31 IgG antibody in 0.1 ml by interperitoneal injection twice/week with the same dose (0.1, 0.25, 0.5, 2 or 5 mg/kg). The mice (n=10 control and treated animals) were killed at day 4, 7, 11, 14, 17 and 21 after initiation of injections, and the tumors were excised and weighed.

The results show that there was a significant suppression of tumor growth when the G6, G6-31, Y0317 and the Avastin™ antibodies were administered (p<0.5) (FIGS. 33A-E). The excised tissues from the anti-VEGF antibody treated mice were smaller in size and less vascularized as compared to the tumors excised from the control mice. As discussed above, the G6 and the G6-23 antibody unlike the Avastin™ antibody and the Y0317 antibody can bind to both human VEGF and mouse VEGF, including mouse stromal VEGF which can be upregulated upon implantation of human colorectal tumors in mouse models. Direct comparison of the activity of the G6 and G6-31 antibodies, which antibodies bind similar epitopes, indicates that at most datapoints the antibody with the higher affinity for VEGF-A, the G6-31 antibody, had increased tumor growth inhibiting properties.

SEQUENCE LISTING (941 sequences)

SEQ ID NO: 1 - protein, 6 aa, Artificial Sequence
  CDR-H2
  MISC_FEATURE (2)..(2): Xaa is Ile, Val, or any other hydrophobic amino acid
  MISC_FEATURE (5)..(5): Xaa is any amino acid
GXTPXG

SEQ ID NO: 2 - protein, 5 aa, Artificial Sequence
  CDR-H1
  MISC_FEATURE (1)..(1): Xaa is any amino acid
  MISC_FEATURE (2)..(2): Xaa is Tyr or Phe
  MISC_FEATURE (3)..(3): Xaa is Trp or Leu
XXXIH

SEQ ID NO: 3 - DNA, 51 bp, Artificial Sequence
  Oligonucleotide
  misc_feature (22)..(22): k is independently g or t
  misc_feature (26)..(26): m is independently a or c
  misc_feature (28)..(28): k is independently g or t
  misc_feature (29)..(29): m is independently a or c
  misc_feature (31)..(31): k is independently g or t
  misc_feature (32)..(32): s is g or c
gcagcttctggcttcaccattkccgmtkmtksgatacactgggtgcgtcag

SEQ ID NO: 4 - DNA, 72 bp, Artificial Sequence
  Oligonucleotide
  misc_feature (23)..(23): s is g or c
  misc_feature (28)..(28): r is a or g
  misc_feature (35)..(35): s is independently g or c
  misc_feature (38)..(38): s is independently g or c
  misc_feature (43)..(43): k is independently g or t
  misc_feature (44)..(44): m is a or c
  misc_feature (49)..(49): k is independently g or t
  misc_feature (50)..(50): m is a or c
aagggcctggaatgggttgcagstattrctcctgstgstggtkmtactkmttatgccgatagcgtcaagggc

SEQ ID NO: 5 - DNA, 66 bp, Artificial Sequence
  Oligonucleotide
  misc_feature (25)..(25): k is independently g or t
  misc_feature (26)..(26): y is independently c or t
  misc_feature (29)..(29): y is independently c or t
  misc_feature (31)..(31): k is independently g or t
  misc_feature (32)..(32): y is independently c or t
  misc_feature (34)..(34): k is independently g or t
  misc_feature (35)..(35): y is independently c or t
  misc_feature (37)..(37): s is independently g or c
  misc_feature (38)..(38): y is independently c or t
  misc_feature (40)..(40): s is independently g or c
  misc_feature (43)..(43): k is independently g or t
  misc_feature (44)..(44): m is a or c
actgccgtctattattgtgcacgckytgytkytkytsytscakmtgctatggactactggggtcaa

SEQ ID NO: 6 - DNA, 55 bp, Artificial Sequence
  Oligonucleotide
  misc_feature (16)..(16): s is independently g or c
  misc_feature (17)..(17): m is independently a or c
  misc_feature (20)..(20): m is independently a or c
  misc_feature (23)..(23): y is c or t
  misc_feature (25)..(25): k is g or t
  misc_feature (28)..(28): r is a or g
  misc_feature (32)..(32): s is independently g or c
acctgccgtgccagtsmagmtgytkccrctgstgtagcctggtatcaacagaaac

SEQ ID NO: 7 - DNA, 54 bp, Artificial Sequence
  Oligonucleotide
  misc_feature (16)..(16): k is independently g or t
  misc_feature (17)..(17): m is independently a or c
  misc_feature (19)..(19): k is independently g or t
  misc_feature (28)..(28): k is independently g or t
  misc_feature (29)..(29): y is c or t
  misc_feature (34)..(34): k is independently g or t
  misc_feature (35)..(35): m is independently a or c
ccgaagcttctgattkmtkccgcatcckytctckmttctggagtcccttctcgc

SEQ ID NO: 8 - DNA, 57 bp, Artificial Sequence
  Oligonucleotide
  misc_feature (16)..(16): s is independently g or c
  misc_feature (17)..(17): m is independently a or c
  misc_feature (22)..(22): k is independently g or t
  misc_feature (25)..(25): k is independently g or t
  misc_feature (26)..(26): m is independently a or c
  misc_feature (28)..(28): r is independently a or g
  misc_feature (31)..(31): r is independently a or g
  misc_feature (37)..(37): s is independently g or c
gcaacttattactgtsmacaakcckmtrctrctcctscaacgttcggacagggtacc

SEQ ID NO: 9 - DNA, 57 bp, Artificial Sequence
  Oligonucleotide
  misc_feature (16)..(16): r is independently a or g
  misc_feature (17)..(17): m is independently a or c
  misc_feature (23)..(23): s is independently g or c
  misc_feature (25)..(25): k is independently g or t
  misc_feature (26)..(26): m is independently a or c
  misc_feature (29)..(29): s is independently g or c
  misc_feature (31)..(31): r is independently a or g
  misc_feature (32)..(32): m is independently a or c
  misc_feature (37)..(37): k is independently g or t
  misc_feature (38)..(38): s is independently g or c
gcaacttattactgtrmacaagstkmtgstrmccctksgacgttcggacagggtacc

SEQ ID NO: 10 - DNA, 51 bp, Artificial Sequence
  Oligonucelotide
  misc_feature (22)..(22): k is independently g or t
  misc_feature (27)..(27): m is a or c
  misc_feature (29)..(29): w is a or t
  misc_feature (31)..(31): y is c or t
  misc_feature (32)..(32): k is independently g or t
gcagcttctggcttcaccattkccgamtwcykgatacactgggtgcgtcag

SEQ ID NO: 11 - DNA, 72 bp, Artificial Sequence
  Oligonucleotide
  misc_feature (23)..(23): s is independently g or c
  misc_feature (25)..(25): r is a or g
  misc_feature (29)..(29): s is independently g or c
  misc_feature (31)..(31): s is independently g or c
  misc_feature (34)..(34): k is g or t
  misc_feature (38)..(38): s is independently g or c
  misc_feature (41)..(41): s is independently g or c
  misc_feature (44)..(44): w is independently a or t
  misc_feature (47)..(47): s is independently g or c
  misc_feature (50)..(50): w is independently a or t
aagggcctggaatgggttgcagstrttascscakctgstgsttwcasctwctatgccgatagcgtcaagggc

SEQ ID NO: 12 - DNA, 66 bp, Artificial Sequence
  Oligonucleotide
  misc_feature (26)..(26): w is independently a or t
  misc_feature (28)..(28): r is a or g
  misc_feature (32)..(32): w is independently a or t
  misc_feature (35)..(35): w is independently a or t
  misc_feature (37)..(37): m is a or c
  misc_feature (40)..(40): s is g or c
  misc_feature (44)..(44): w is independently a or t
actgccgtctattattgtgcacgctwcrtttwctwcmtcscatwcgctatggactactggggtcaa

SEQ ID NO: 13 - DNA, 55 bp, Artificial Sequence
  Oligonucleotide
  misc_feature (16)..(16): s is independently g or c
  misc_feature (21)..(21): m is a or c
  misc_feature (22)..(22): r is a or g
  misc_feature (25)..(25): k is independently g or t
  misc_feature (29)..(29): s is independently g or c
  misc_feature (31)..(31): k is independently g or t
acctgccgtgccagtsaagamrttkccasckctgtagcctggtatcaacagaaac

SEQ ID NO: 14 - DNA, 54 bp, Artificial Sequence
  Oligonucleotide
  misc_feature (17)..(17): w is independently a or t
  misc_feature (19)..(19): k is g or t
  misc_feature (29)..(29): w is independently a or t
  misc_feature (35)..(35): w is independently a or t
ccgaagcttctgatttwckccgcatcctwcctctwctctggagtcccttctcgc

SEQ ID NO: 15 - DNA, 57 bp, Artificial Sequence
  Oligonucleotide
  misc_feature (16)..(16): v is independently a, c, or g
  misc_feature (18)..(18): r is independently a or g
  misc_feature (19)..(19): v is independently a, c, or g
  misc_feature (21)..(21): r is independently a or g
  misc_feature (22)..(22): k is g or t
  misc_feature (26)..(26): w is a or t
  misc_feature (29)..(29): s is independently g or c
  misc_feature (32)..(32): s is independently g or c
  misc_feature (37)..(37): s is independently g or c
gcaacttattactgtvarvarkcctwcascasccctscaacgttcggacagggtacc

SEQ ID NO: 16 - DNA, 57 bp, Artificial Sequence
  Oligonucleotide
  misc_feature (16)..(16): v is independently a, c, or g
  misc_feature (18)..(18): r is independently a or g
  misc_feature (19)..(19): v is independently a, c, or g
  misc_feature (21)..(21): r is independently a or g
  misc_feature (23)..(23): s is g or c
  misc_feature (26)..(26): w is a or t
  misc_feature (28)..(28): k is independently g or t
  misc_feature (31)..(31): r is independently a or g
  misc_feature (38)..(38): k is independently g or t
gcaacttattactgtvarvargsttwckctracccttkgacgttcggacagggtacc

SEQ ID NO: 17 - protein, 14 aa, Artificial Sequence
  Epitope tag
MADPNRFRGKDLGG

SEQ ID NO: 18 - protein, 35 aa, Artificial Sequence
  Leucine zipper
GRMKQLEDKVEELLSKNYHLENEVARLKKLVGERG

SEQ ID NO: 19 - protein, 213 aa, Artificial Sequence
  YADS1 Fab light chain
DIQMTQSPSSLSASVGDRVTITCRASQASYSSVAWYQQKPGKAPKLLIYAASYLYSGVPSRFSGSGSGTDFTLTISSLQPEDFATYYCQSSASPATFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20 - protein, 252 aa, Artificial Sequence
  YADS1 Fab heavy chain
MKKNIAFLLASMFVFSIATNAYAEVQLVESGGGLVQPGGSLRLSCAASGFDIYDDDIHWVRQAPGKGLEWVAYIAPSYGYTDYADSVKGRFTISADTSKNTAYLQMNSLRAEDTAVYYCSRSSDASYSYSAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 21 - protein, 214 aa, Artificial Sequence
  YADS2 Fab light chain
DIQMTQSPSSLSASVGDRVTITCRASQSYAYAVAWYQQKPGKAPKLLIYDASYLYSGVPSRFSGSGSGTDFTLTISSLQPEDFATYYCQQAYSSPDTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 22 - protein, 250 aa, Artificial Sequence
  YADS2 Fab heavy chain
MKKNIAFLLASMFVFSIATNAYAEVQLVESGGGLVQPGGSLRLSCAASGFAISDYDIHWVRQAPGKGLEWVADIAPYAGATAYADSVKGRFTISADTSKNTAYLQMNSLRAEDTAVYYCSRSSYAYYAAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 23 - protein, 214 aa, Artificial Sequence
  YADS3 Fab light chain
DIQMTQSPSSLSASVGDRVTITCRASQASYYDVAWYQQKPGKAPKLLIYAASYLYSGVPSRFSGSGSGTDFTLTISSLQPEDFATYYCQQYYYAPATFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 24 - protein, 250 aa, Artificial Sequence
  YADS3 Fab heavy chain
MKKNIAFLLASMFVFSIATNAYAEVQLVESGGGLVQPGGSLRLSCAASGFSISDYDIHWVRQAPGKGLEWVAAIAPYSGSTYYADSVKGRFTISADTSKNTAYLQMNSLRAEDTAVYYCSRSSYAYYSAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 25 - DNA, 48 bp, Artificial Sequence
  Oligonucleotide
gcagcttctggcttcgctatttatgattatgatatacactgggtgcgt

SEQ ID NO: 26 - DNA, 60 bp, Artificial Sequence
  Oligonucleotide
  misc_feature (16)..(17): n is independently a, t, g, or c
  misc_feature (18)..(18): k is g or t
ctggaatgggttgcannkattgctccatatgctggtgctactgcttatgccgatagcgtc

SEQ ID NO: 27 - DNA, 54 bp, Artificial Sequence
  Oligonucleotide
  misc_feature (19)..(20): n is independently a, t, g, or c
  misc_feature (21)..(21): k is independently g or t
  misc_feature (25)..(26): n is independently a, t, g, or c
  misc_feature (27)..(27): k is independently g or t
  misc_feature (31)..(32): n is independently a, t, g, or c
  misc_feature (33)..(33): k is independently g or t
  misc_feature (34)..(35): n is independently a, t, g, or c
  misc_feature (36)..(36): k is independently g or t
  misc_feature (37)..(38): n is independently a, t, g, or c
  misc_feature (39)..(39): k is independently g or t
gtctattattgtagccgcnnktctnnkgctnnknnknnkgctatggactactgg

SEQ ID NO: 28 - protein, 214 aa, Artificial Sequence
  G6 Fab light chain
DIQMTQSPSSLSASVGDRVTITCRASQDVSTAVAWYQQKPGKAPKLLIYSASFLYSGVPSRFSGSGSGTDFTLTISSLQPEDFATYYCQQSYTTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 29 - protein, 226 aa, Artificial Sequence
  G6 Fab heavy chain
EVQLVESGGGLVQPGGSLRLSCAASGFTISDYWIHWVRQAPGKGLEWVAGITPAGGYTYYADSVKGRFTISADTSKNTAYLQMNSLRAEDTAVYYCARFVFFLPYAMDYWGQGTLVTVSSASTKGPSVFPLAPSSKSTSGGTAALGCLVKDYFPEPVTVSWNSGALTSGVHTFPAVQSSGLYSLSSVVTVPSSSLGTQTYICNVNHKPSNTKVDKKVEPKSCDKTH

SEQ ID NO: 30 - protein, 214 aa, Artificial Sequence
  G6-23 Fab light chain
DIQMTQSPSSLSASVGDRVTITCRASQDVSTAVAWYQQKPGKAPKLLIYSASFLYSGVPSRFSGSGSGTDFTLTISSLQPEDFATYYCKQGYANPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 31 - protein, 227 aa, Artificial Sequence
  G6-23 Fab heavy chain
EVQLVESGGGLVQPGGSLRLSCAASGFTISDYWIHWVRQAPGKGLEWVAGITPAGGYTYYADSVKGRFTISADTSKNTAYLQMNSLRAEDTAVYYCARFVFFLPYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 32 - protein, 214 aa, Artificial Sequence
  G6-31 Fab light chain
DIQMTQSPSSLSASVGDRVTITCRASQDVSTAVAWYQQKPGKAPKLLIYSASFLYSGVPSRFSGSGSGTDFTLTISSLQPEDFATYYCQQGYGNPFTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 33 - protein, 214 aa, Artificial Sequence
  G6-8 Fab light chain
DIQMTQSPSSLSASVGDRVTITCRASQDVSTAVAWYQQKPGKAPKLLIYSASFLYSGVPSRFSGSGSGTDFTLTISSLQPEDFATYYCQQGAGSPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 34 - protein, 214 aa, Artificial Sequence
  G6-23.1 Fab light chain
DIQMTQSPSSLSASVGDRVTITCRASQDVSTAVAWYQQKPGKAPKLLIYSASFLYSGVPSRFSGSGSGTDFTLTISSLQPEDFATYYCKQGFANPFTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 35 - protein, 227 aa, Artificial Sequence
  G6-23.1 Fab heavy chain
EVQLVESGGGLVQPGGSLRLSCAASGFTISDYWIHWVRQAPGKGLEWVAGVTPAGGYTYYADSVKGRFTISADTSKNTAYLQMNSLRAEDTAVYYCARFVFFLPYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 36 - protein, 227 aa, Artificial Sequence
  G6-23.2 Fab heavy chain
EVQLVESGGGLVQPGGSLRLSCAASGFTISDYWIHWVRQAPGKGLEWVAGVTPAGGYTAYADSVKGRFTISADTSKNTAYLQMNSLRAEDTAVYYCARFVFFLPYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 37 - protein, 214 aa, Artificial; identical to SEQ ID NO: 28
  B20 Fab light chain

SEQ ID NO: 38 - protein, 228 aa, Artificial Sequence
  B20 Fab heavy chain
EVQLVESGGGLVQPGGSLRLSCAASGFTINASWIHWVRQAPGKGLEWVGAIYPYSGYTNYADSVKGRFTISADTSKNTAYLQMNSLRAEDTAVYYCARWGHSTSPWAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 39 - protein, 214 aa, Artificial Sequence
  B20-4 Fab light chain
DIQMTQSPSSLSASVGDRVTITCRASQVIRRSLAWYQQKPGKAPKLLIYAASNLASGVPSRFSGSGSGTDFTLTISSLQPEDFATYYCQQSNTSPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 40 - protein, 214 aa, Artificial Sequence; identical to SEQ ID NO: 39
  B20-4.1 Fab light chain

SEQ ID NO: 41 - protein, 228 aa, Artificial Sequence
  B20-4.1 Fab heavy chain
EVQLVESGGGLVQPGGSLRLSCAASGFSINGSWIFWVRQAPGKGLEWVGAIWPFGGYTHYADSVKGRFTISADTSKNTAYLQMNSLRAEDTAVYYCARWGHSTSPWAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 42 - protein, 214 aa, Artificial Sequence
  YS1 Fab light chain
DIQMTQSPSSLSASVGDRVTITCRASQSYAYAVAWYQQKPGKAPKLLIYDASYLYSGVPSRFSGSGSGTDFTLTISSLQPEDFATYYCQQSYYSPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 43 - protein, 232 aa, Artificial Sequence
  YS1 Fab heavy chain
EVQLVESGGGLVQPGGSLRLSCAASGFSISSSSIHWVRQAPGKGLEWVAYISPSSGSTSYADSVKGRFTISADTSKNTAYLQMNSLRAEDTAVYYCSRYYSSSYYYSYYYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 44 - protein, 11 aa, Artificial Sequence
  G6-6a Light chain CDR1
RASQNVATFLA

SEQ ID NO: 45 - protein, 7 aa, Artificial Sequence
  G6-6a Light chain CDR2
SASNLAS

SEQ ID NO: 46 - protein, 9 aa, Artificial Sequence
  G6-6a Light chain CDR3
QQSYGSLPT

SEQ ID NO: 47 - protein, 214 aa, Artificial Sequence
  G6-6a Fab light chain
DIQMTQSPSSLSASVGDRVTITCRASQNVATFLAWYQQKPGKAPKLLIYSASNLASGVPSRFSGSGSGTDFTLTISSLQPEDFATYYCQQSYGSPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 48 - protein, 11 aa, Artificial Sequence
  G6-23 CDR1 light chain
RASQDVSTAVA

SEQ ID NO: 49 - protein, 7 aa, Artificial Sequence
  G6-23 CDR2 light chain
SASFLYS

SEQ ID NO: 50 - protein, 9 aa, Artificial Sequence
  G6-23 CDR3 light chain
QQGYANPWT

SEQ ID NO: 51 - protein, 214 aa, Artificial Sequence
  G6-23 Fab light chain
DIQMTQSPSSLSASVGDRVTITCRASQDVSTAVAWYQQKPGKAPKLLIYSASFLYSGVPSRFSGSGSGTDFTLTISSLQPEDFATYYCQQGYANPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 52 - protein, 9 aa, Artificial Sequence
  G6-31 CDR3 light chain
QQGYGNPFT

SEQ ID NO: 53 - protein, 214 aa, Artificial Sequence; identical to SEQ ID NO: 32
  G6-31 Fab light chain

SEQ ID NO: 54 - protein, 9 aa, Artificial Sequence
  G6-2a CDR3 light chain
QQGYGSPLT

SEQ ID NO: 55 - protein, 214 aa, Artificial Sequence
  G6-2a Fab light chain
DIQMTQSPSSLSASVGDRVTITCRASQDVSTAVAWYQQKPGKAPKLLIYSASFLYSGVPSRFSGSGSGTDFTLTISSLQPEDFATYYCQQGYGSPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 56 - protein, 11 aa, Artificial Sequence
  G6-2b CDR1 light chain
RASQGGTTSLA

SEQ ID NO: 57 - protein, 7 aa, Artificial Sequence
  G6-2b CDR2 light chain
SASNLAS

SEQ ID NO: 58 - protein, 9 aa, Artificial Sequence
  G6-2b CDR3 light chain
QQGYGSPFT

SEQ ID NO: 59 - protein, 214 aa, Artificial Sequence
  G6-2b Fab light chain
DIQMTQSPSSLSASVGDRVTITCRASQGGTTSLAWYQQKPGKAPKLLIYSASNLASGVPSRFSGSGSGTDFTLTISSLQPEDFATYYCQQGYGSPFTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 60 - protein, 11 aa, Artificial Sequence
  G6-6b CDR1 light chain
RASQIVTNSLA

SEQ ID NO: 61 - protein, 7 aa, Artificial Sequence
  G6-6b CDR2 light chain
LASSLAS

SEQ ID NO: 62 - protein, 9 aa, Artificial Sequence
  G6-2b CDR3 light chain
QQGATDPRT

SEQ ID NO: 63 - protein, 214 aa, Artificial Sequence
  G6-6b Fab light chain
DIQMTQSPSSLSASVGDRVTITCRASQIVTNSLAWYQQKPGKAPKLLIYLASSLASEVPSRFSGSGSGTDFTLTISSLQPEDFATYYCQQGATDPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 64 - protein, 9 aa, Artificial Sequence
  G6-48 CDR3 light chain
QQGTSSPPT

SEQ ID NO: 65 - protein, 214 aa, Artificial Sequence
  G6-48 Fab light chain
DIQMTQSPSSLSASVGDRVTITCRASQDVSTAVAWYQQKPGKAPKLLIYSASFLYSGVPSRFSGSGSGTDFTLTISSLQPEDFATYYCQQGTSSPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 66 - protein, 8 aa, Artificial Sequence
  G6-1a CDR3 light chain
QQGTGNPT

SEQ ID NO: 67 - protein, 214 aa, Artificial Sequence
  G6-1a Fab light chain
DIQMTQSPSSLSASVGDRVTITCRASQDVSTAVAWYQQKPGKAPKLLIYSASFLYSGVPSRFSGSGSGTDFTLTISSLQPEDFATYYCQQGTGNPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 68 - protein, 9 aa, Artificial Sequence
  G6-8 CDR3 light chain
QQGAGSPLT

SEQ ID NO: 69 - protein, 214 aa, Artificial Sequence; identical to SEQ ID NO: 33
  G6-8 Fab light chain

SEQ ID NO: 70 - protein, 7 aa, Artificial Sequence
  G6-3 CDR2 light chain
AASFLYS

SEQ ID NO: 71 - protein, 9 aa, Artificial Sequence
  G6-3 CDR3 light chain
QQGSGHPFT

SEQ ID NO: 72 - protein, 214 aa, Artificial Sequence
  G6-3 Fab light chain
DIQMTQSPSSLSASVGDRVTITCRASQDVSTAVAWYQQKPGKAPKLLIYAASFLYSGVPSRFSGSGSGTDFTLTISSLQPEDFATYYCQQGSGHPFTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 73 - protein, 9 aa, Artificial Sequence
  G6-34 CDR3 light chain
QQGTGSPLT

SEQ ID NO: 74 - protein, 214 aa, Artificial Sequence
  G-6-34 Fab light chain
DIQMTQSPSSLSASVGDRVTITCRASQDVSTAVAWYQQKPGKAPKLLIYSASFLYSGVPSRFSGSGSGTDFTLTISSLQPEDFATYYCQQGTGSPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 75 - protein, 9 aa, Artificial Sequence
  G6-4a CDR3 light chain
QQGSGNPFT

SEQ ID NO: 76 - protein, 214 aa, Artificial Sequence
  G6-4a Fab light chain
DIQMTQSPSSLSASVGDRVTITCRASQDVSTAVAWYQQKPGKAPKLLIYSASFLYSGVPSRFSGSGSGTDFTLTISSLQPEDFATYYCQQGSGNPFTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 77 - protein, 9 aa, Artificial Sequence
  G6-1a CDR3 light chain
QQGTGNPLT

SEQ ID NO: 78 - protein, 214 aa, Artificial Sequence
  G6-1a Fab light chain
DIQMTQSPSSLSASVGDRVTITCRASQDVSTAVAWYQQKPGKAPKLLIYSASFLYSGVPSRFSGSGSGTDFTLTISSLQPEDFATYYCQQGTGNPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 79 - protein, 9 aa, Artificial Sequence
  G6-4b CDR3 light chain
QQGSGSPFT

SEQ ID NO: 80 - protein, 214 aa, Artificial Sequence
  G6-4b Fab light chain
DIQMTQSPSSLSASVGDRVTITCRASQDVSTAVAWYQQKPGKAPKLLIYSASFLYSGVPSRFSGSGSGTDFTLTISSLQPEDFATYYCQQGSGSPFTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 81 - protein, 9 aa, Artificial Sequence
  G6-5 CDR3 light chain
QQGAGSPFT

SEQ ID NO: 82 - protein, 214 aa, Artificial Sequence
  G6-5 Fab light chain
DIQMTQSPSSLSASVGDRVTITCRASQDVSTAVAWYQQKPGKAPKLLIYSASFLYSGVPSRFSGSGSGTDFTLTISSLQPEDFATYYCQQGAGSPFTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 83 - protein, 9 aa, Artificial Sequence
  G6-15 CDR3 light chain
QQGVNSPLT

SEQ ID NO: 84 - protein, 214 aa, Artificial Sequence
  G6-15 Fab light chain
DIQMTQSPSSLSASVGDRVTITCRASQDVSTAVAWYQQKPGKAPKLLIYSASFLYSGVPSRFSGSGSGTDFTLTISSLQPEDFATYYCQQGVNSPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 85 - protein, 11 aa, Artificial Sequence
  B20 CDR-L1
RASQDVSTAVA

SEQ ID NO: 86 - protein, 7 aa, Artificial Sequence
  B20 CDR-L2
SASFLYS

SEQ ID NO: 87 - protein, 9 aa, Artificial Sequence
  B20 CDR-L3
QQSYTTPPT

SEQ ID NO: 88 - protein, 214 aa, Artificial Sequence; identical to SEQ ID NO: 28
  B20 LC

SEQ ID NO: 89 - protein, 11 aa, Artificial Sequence
  B20-50 CDR-L1
RASQDVSTAVA

SEQ ID NO: 90 - protein, 7 aa, Artificial Sequence
  B20-50 CDR-L2
SASFLYS

SEQ ID NO: 91 - protein, 9 aa, Artificial Sequence
  B20-50 CDR-L3
QQSYGAPLT

SEQ ID NO: 92 - protein, 214 aa, Artificial Sequence
  B20-50 LC
DIQMTQSPSSLSASVGDRVTITCRASQDVSTAVAWYQQKPGKAPKLLIYSASFLYSGVPSRFSGSGSGTDFTLTISSLQPEDFATYYCQQSYGAPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 93 - protein, 11 aa, Artificial Sequence
  B20-59 CDR-L1
RASQDVSTAVA

SEQ ID NO: 94 - protein, 7 aa, Artificial Sequence
  B20-59 CDR-L2
SASFLYS

SEQ ID NO: 95 - protein, 9 aa, Artificial Sequence
  B20-59 CDR-L3
QQSYSSPLT

SEQ ID NO: 96 - protein, 214 aa, Artificial Sequence
  B20-59 LC
DIQMTQSPSSLSASVGDRVTITCRASQDVSTAVAWYQQKPGKAPKLLIYSASFLYSGVPSRFSGSGSGTDFTLTISSLQPEDFATYYCQQSYSSPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 97 - protein, 11 aa, Artificial Sequence
  B20-73 CDR-L1
RASQGVRTSLA

SEQ ID NO: 98 - protein, 7 aa, Artificial Sequence
  B20-73 CDR-L2
GASTLAS

SEQ ID NO: 99 - protein, 9 aa, Artificial Sequence
  B20-73 CDR-L3
QQSYASPLT

SEQ ID NO: 100 - protein, 214 aa, Artificial Sequence
  B20-73 LC
DIQMTQSPSSLSASVGDRVTITCRASQGVRTSLAWYQQKPGKAPKLLIYGASTLASGVPSRFSGSGSGTDFTLTISSLQPEDFATYYCQQSYASPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 101 - protein, 11 aa, Artificial Sequence
  B20-3 CDR-L1
RASQVIGRSLA

SEQ ID NO: 102 - protein, 7 aa, Artificial Sequence
  B20-3 CDR-L2
SASFLYS

SEQ ID NO: 103 - protein, 9 aa, Artificial Sequence
  B20-3 CDR-L3
QQSYASPLT

SEQ ID NO: 104 - protein, 214 aa, Artificial Sequence
  B20-3 LC
DIQMTQSPSSLSASVGDRVTITCRASQVIGRSLAWYQQKPGKAPKLLIYSASFLYSGVPSRFSGSGSGTDFTLTISSLQPEDFATYYCQQSYASPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 105 - protein, 11 aa, Artificial Sequence
  B20-8 CDR-L1
RASQDVSTAVA

SEQ ID NO: 106 - protein, 7 aa, Artificial Sequence
  B20-8 CDR-L2
SASFLYS

SEQ ID NO: 107 - protein, 9 aa, Artificial Sequence
  B20-8 CDR-L3
QQSYGSPLT

SEQ ID NO: 108 - protein, 214 aa, Artificial Sequence
  B20-8 LC
DIQMTQSPSSLSASVGDRVTITCRASQDVSTAVAWYQQKPGKAPKLLIYSASFLYSGVPSRFSGSGSGTDFTLTISSLQPEDFATYYCQQSYGSPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 109 - protein, 11 aa, Artificial Sequence
  B20-2 CDR-L1
RASQNVRSSLA

SEQ ID NO: 110 - protein, 7 aa, Artificial Sequence
  B20-2 CDR-L2
SASNLES

SEQ ID NO: 111 - protein, 9 aa, Artificial Sequence
  B20-2 CDR-L3
QQSYAAPLT

SEQ ID NO: 112 - protein, 214 aa, Artificial Sequence
  B20-2 LC
DIQMTQSPSSLSASVGDRVTITCRASQNVRSSLAWYQQKPGKAPKLLIYSASNLESGVPSRFSGSGSGTDFTLTISSLQPEDFATYYCQQSYAAPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 113 - protein, 11 aa, Artificial Sequence
  B20-4a CDR-L1
RASQVIGTSLA

SEQ ID NO: 114 - protein, 7 aa, Artificial Sequence
  B20-4a CDR-L2
SASNLAS

SEQ ID NO: 115 - protein, 9 aa, Artificial Sequence
  B20-4a CDR-L3
QQSYGSPLT

SEQ ID NO: 116 - protein, 214 aa, Artificial Sequence
  B20-4a LC
DIQMTQSPSSLSASVGDRVTITCRASQVIGTSLAWYQQKPGKAPKLLIYSASNLASGVPSRFSGSGSGTDFTLTISSLQPEDFATYYCQQSYGSPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 117 - protein, 11 aa, Artificial Sequence
  B20-4 CDR-L1
RASQVIRRSLA

SEQ ID NO: 118 - protein, 7 aa, Artificial Sequence
  B20-4 CDR-L2
AASNLAS

SEQ ID NO: 119 - protein, 9 aa, Artificial Sequence
  B20-4 CDR-L3
QQSNTSPLT

SEQ ID NO: 120 - protein, 214 aa, Artificial Sequence; identical to SEQ ID NO: 39
  B20-4 LC

SEQ ID NO: 121 - protein, 11 aa, Artificial Sequence
  B20-6 CDR-L1
RASQDVSTAVA

SEQ ID NO: 122 - protein, 7 aa, Artificial Sequence
  B20-6 CDR-L2
SASTLAS

SEQ ID NO: 123 - protein, 9 aa, Artificial Sequence
  B20-6 CDR-L3
QQSTTSPLT

SEQ ID NO: 124 - protein, 214 aa, Artificial Sequence
  B20-6 LC
DIQMTQSPSSLSASVGDRVTITCRASQDVSTAVAWYQQKPGKAPKLLIYSASTLASGVPSRFSGSGSGTDFTLTISSLQPEDFATYYCQQSTTSPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 125 - protein, 11 aa, Artificial Sequence
  B20-5 CDR-L1
RASQDVSTAVA

SEQ ID NO: 126 - protein, 7 aa, Artificial Sequence
  B20-5 CDR-L2
SASFLYS

SEQ ID NO: 127 - protein, 9 aa, Artificial Sequence
  B20-5 CDR-L3
QQSTNSPLT

SEQ ID NO: 128 - protein, 214 aa, Artificial Sequence
  B20-5 LC
DIQMTQSPSSLSASVGDRVTITCRASQDVSTAVAWYQQKPGKAPKLLIYSASFLYSGVPSRFSGSGSGTDFTLTISSLQPEDFATYYCQQSTNSPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 129 - protein, 11 aa, Artificial Sequence
  B20-1a CDR-L1
RASQGVKNSLA

SEQ ID NO: 130 - protein, 7 aa, Artificial Sequence
  B20-1a CDR-L2
SASTLES

SEQ ID NO: 131 - protein, 9 aa, Artificial Sequence
  B20-1a CDR-L3
QQSNASPLT

SEQ ID NO: 132 - protein, 214 aa, Artificial Sequence
  B20-1a LC
DIQMTQSPSSLSASVGDRVTITCRASQGVKNSLAWYQQKPGKAPKLLIYSASTLESGVPSRFSGSGSGTDFTLTISSLQPEDFATYYCQQSNASPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 133 - protein, 11 aa, Artificial Sequence
  B20-1 CDR-L1
RASQDVRTSLA

SEQ ID NO: 134 - protein, 7 aa, Artificial Sequence
  B20-1 CDR-L2
GASTLAS

SEQ ID NO: 135 - protein, 9 aa, Artificial Sequence
  B20-1 CDR-L3
QQSNSSPLT

SEQ ID NO: 136 - protein, 214 aa, Artificial Sequence
  B20-1 LC
DIQMTQSPSSLSASVGDRVTITCRASQDVRTSLAWYQQKPGKAPKLLIYGASTLASGVPSRFSGSGSGTDFTLTISSLQPEDFATYYCQQSNSSPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 137 - protein, 11 aa, Artificial Sequence
  B20-13 CDR-L1
RASQNVRNFLA

SEQ ID NO: 138 - protein, 7 aa, Artificial Sequence
  B20-13 CDR-L2
SASTLAS

SEQ ID NO: 139 - protein, 9 aa, Artificial Sequence
  B20-13 CDR-L3
QQHTNSPLT

SEQ ID NO: 140 - protein, 214 aa, Artificial Sequence
  B20-13 LC
DIQMTQSPSSLSASVGDRVTITCRASQNVRNFLAWYQQKPGKAPKLLIYSASTLASGVPSRFSGSGSGTDFTLTISSLQPEDFATYYCQQHTNSPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 141 - protein, 11 aa, Artificial Sequence
  G623 CDR-L1
RASQDVSTAVA

SEQ ID NO: 142 - protein, 7 aa, Artificial Sequence
  G623 CDR-L2
SASFLYS

SEQ ID NO: 143 - protein, 9 aa, Artificial Sequence
  G623 CDR-L3
KQGYANPWT

SEQ ID NO: 144 - protein, 214 aa, Artificial Sequence; identical to SEQ ID NO: 30
  G623 LC

SEQ ID NO: 145 - protein, 11 aa, Artificial Sequence
  G623_57 CDR-L1
RASEAVSAAVA

SEQ ID NO: 146 - protein, 7 aa, Artificial Sequence
  G623_57 CDR-L2
SASFLSS

SEQ ID NO: 147 - protein, 9 aa, Artificial Sequence
  G623_57 CDR-L3
AQGYAAPST

SEQ ID NO: 148 - protein, 214 aa, Artificial Sequence
  G623_57 LC
DIQMTQSPSSLSASVGDRVTITCRASEAVSAAVAWYQQKPGKAPKLLIYSASFLSSGVPSRFSGSGSGTDFTLTISSLQPEDFATYYCAQGYAAPSTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 149 - protein, 11 aa, Artificial Sequence
  G623_13 CDR-L1
RASAAVAAAVA

SEQ ID NO: 150 - protein, 7 aa, Artificial Sequence
  G623_13 CDR-L2
SASFLAS

SEQ ID NO: 151 - protein, 9 aa, Artificial Sequence
  G623_13 CDR-L3
AQGYGAPST

SEQ ID NO: 152 - protein, 214 aa, Artificial Sequence
  G623_13 LC
DIQMTQSPSSLSASVGDRVTITCRASAAVAAAVAWYQQKPGKAPKLLIYSASFLASGVPSRFSGSGSGTDFTLTISSLQPEDFATYYCAQGYGAPSTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 153 - protein, 11 aa, Artificial Sequence
  G623_87 CDR-L1
RASQEVATAVA

SEQ ID NO: 154 - protein, 7 aa, Artificial Sequence
  G623_87 CDR-L2
SASYLYS

SEQ ID NO: 155 - protein, 9 aa, Artificial Sequence
  G623_87 CDR-L3
KQGFSDPWT

SEQ ID NO: 156 - protein, 214 aa, Artificial Sequence
  G623_87 LC
DIQMTQSPSSLSASVGDRVTITCRASQEVATAVAWYQQKPGKAPKLLIYSASYLYSGVPSRFSGSGSGTDFTLTISSLQPEDFATYYCKQGFSDPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 157 - protein, 11 aa, Artificial Sequence
  G623_77 CDR-L1
RASEEVATAVA

SEQ ID NO: 158 - protein, 7 aa, Artificial Sequence
  G623_77 CDR-L2
AASFLYS

SEQ ID NO: 159 - protein, 9 aa, Artificial Sequence
  G623_77 CDR-L3
KQGYANPWT

SEQ ID NO: 160 - protein, 214 aa, Artificial Sequence
  G623_77 LC
DIQMTQSPSSLSASVGDRVTITCRASEEVATAVAWYQQKPGKAPKLLIYAASFLYSGVPSRFSGSGSGTDFTLTISSLQPEDFATYYCKQGYANPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 161 - protein, 11 aa, Artificial Sequence
  G623_20 CDR-L1
RASADVAAAVA

SEQ ID NO: 162 - protein, 7 aa, Artificial Sequence
  G623_20 CDR-L2
SASFLAS

SEQ ID NO: 163 - protein, 9 aa, Artificial Sequence
  G623_20 CDR-L3
AQGSGAPAT

SEQ ID NO: 164 - protein, 214 aa, Artificial Sequence
  G623_20 LC
DIQMTQSPSSLSASVGDRVTITCRASADVAAAVAWYQQKPGKAPKLLIYSASFLASGVPSRFSGSGSGTDFTLTISSLQPEDFATYYCAQGSGAPATFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 165 - protein, 11 aa, Artificial Sequence
  G623_51 CDR-L1
RASADASTAVA

SEQ ID NO: 166 - protein, 7 aa, Artificial Sequence
  G623_51 CDR-L2
AASFLYS

SEQ ID NO: 167 - protein, 9 aa, Artificial Sequence
  G623_51 CDR-L3
AQGYANPAT

SEQ ID NO: 168 - protein, 214 aa, Artificial Sequence
  G623_51 LC
DIQMTQSPSSLSASVGDRVTITCRASADASTAVAWYQQKPGKAPKLLIYAASFLYSGVPSRFSGSGSGTDFTLTISSLQPEDFATYYCAQGYANPATFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 169 - protein, 11 aa, Artificial Sequence
  G623_36 CDR-L1
RASEEISTAVA

SEQ ID NO: 170 - protein, 7 aa, Artificial Sequence
  G623_36 CDR-L2
SASYLYS

SEQ ID NO: 171 - protein, 9 aa, Artificial Sequence
  G623_36 CDR-L3
KQGPSDPWT

SEQ ID NO: 172 - protein, 214 aa, Artificial Sequence
  G623_36 LC
DIQMTQSPSSLSASVGDRVTITCRASEEISTAVAWYQQKPGKAPKLLIYSASYLYSGVPSRFSGSGSGTDFTLTISSLQPEDFATYYCKQGPSDPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 173 - protein, 11 aa, Artificial Sequence
  G623_80 CDR-L1
RASQEVASAVA

SEQ ID NO: 174 - protein, 7 aa, Artificial Sequence
  G623_80 CDR-L2
SASYLFS

SEQ ID NO: 175 - protein, 9 aa, Artificial Sequence
  G623_80 CDR-L3
KQAFSNPLT

SEQ ID NO: 176 - protein, 214 aa, Artificial Sequence
  G623_80 LC
DIQMTQSPSSLSASVGDRVTITCRASQEVASAVAWYQQKPGKAPKLLIYSASYLFSGVPSRFSGSGSGTDFTLTISSLQPEDFATYYCKQAFSNPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 177 - protein, 11 aa, Artificial Sequence
  G623_66 CDR-L1
RASPDVATGVA

SEQ ID NO: 178 - protein, 7 aa, Artificial Sequence
  G623_66 CDR-L2
SASFLSS

SEQ ID NO: 179 - protein, 9 aa, Artificial Sequence
  G623_66 CDR-L3
AQAYAAPAT

SEQ ID NO: 180 - protein, 214 aa, Artificial Sequence
  G623_66 LC
DIQMTQSPSSLSASVGDRVTITCRASPDVATGVAWYQQKPGKAPKLLIYSASFLSSGVPSRFSGSGSGTDFTLTISSLQPEDFATYYCAQAYAAPATFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 181 - protein, 11 aa, Artificial Sequence
  G623_33 CDR-L1
RASPAVSAAVA

SEQ ID NO: 182 - protein, 7 aa, Artificial Sequence
  G623_33 CDR-L2
SASFLYS

SEQ ID NO: 183 - protein, 9 aa, Artificial Sequence
  G623_33 CDR-L3
AQGSAAPAT

SEQ ID NO: 184 - protein, 214 aa, Artificial Sequence
  G623_33 LC
DIQMTQSPSSLSASVGDRVTITCRASPAVSAAVAWYQQKPGKAPKLLIYSASFLYSGVPSRFSGSGSGTDFTLTISSLQPEDFATYYCAQGSAAPATFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 185 - protein, 11 aa, Artificial Sequence
  G623_59 CDR-L1
RASPAVAAGVA

SEQ ID NO: 186 - protein, 7 aa, Artificial Sequence
  G623_59 CDR-L2
SASFLYS

SEQ ID NO: 187 - protein, 9 aa, Artificial Sequence
  G623_59 CDR-L3
AQAYAAPAT

SEQ ID NO: 188 - protein, 214 aa, Artificial Sequence
  G623_59 LC
DIQMTQSPSSLSASVGDRVTITCRASPAVAAGVAWYQQKPGKAPKLLIYSASFLYSGVPSRFSGSGSGTDFTLTISSLQPEDFATYYCAQAYAAPATFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 189 - protein, 11 aa, Artificial Sequence
  G623_22 CDR-L1
RASPAVAAAVA

SEQ ID NO: 190 - protein, 7 aa, Artificial Sequence
  G623_22 CDR-L2
SASVLYS

SEQ ID NO: 191 - protein, 9 aa, Artificial Sequence
  G623_22 CDR-L3
AQAYAAPAT

SEQ ID NO: 192 - protein, 214 aa, Artificial Sequence
  G623_22 LC
DIQMTQSPSSLSASVGDRVTITCRASPAVAAAVAWYQQKPGKAPKLLIYSASVLYSGVPSRFSGSGSGTDFTLTISSLQPEDFATYYCAQAYAAPATFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 193 - protein, 11 aa, Artificial Sequence
  G623_29 CDR-L1
RASQEVSTAVA

SEQ ID NO: 194 - protein, 7 aa, Artificial Sequence
  G623_29 CDR-L2
SASYLFS

SEQ ID NO: 195 - protein, 9 aa, Artificial Sequence
  G623_29 CDR-L3
KQGFSNPWT

SEQ ID NO: 196 - protein, 214 aa, Artificial Sequence
  G623_29 LC
DIQMTQSPSSLSASVGDRVTITCRASQEVSTAVAWYQQKPGKAPKLLIYSASYLFSGVPSRFSGSGSGTDFTLTISSLQPEDFATYYCKQGFSNPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 197 - protein, 11 aa, Artificial Sequence
  G623_49 CDR-L1
RASPDVATGVA

SEQ ID NO: 198 - protein, 7 aa, Artificial Sequence
  G623_49 CDR-L2
SASFLSS

SEQ ID NO: 199 - protein, 9 aa, Artificial Sequence
  G623_49 CDR-L3
AQAYAAPAT

SEQ ID NO: 200 - protein, 214 aa, Artificial Sequence; identical to SEQ ID NO: 180
  G623_49 LC

SEQ ID NO: 201 - protein, 12 aa, Artificial Sequence
  G623_58 CDR-L1
RASPAVASAAVA

SEQ ID NO: 202 - protein, 7 aa, Artificial Sequence
  G623_58 CDR-L2
AASFLAS

SEQ ID NO: 203 - protein, 9 aa, Artificial Sequence
  G623_58 CDR-L3
AQGSGAPAT

SEQ ID NO: 204 - protein, 214 aa, Artificial Sequence
  G623_58 LC
DIQMTQSPSSLSASVGDRVTITCRASQDVATAVAWYQQKPGKAPKLLIYAASFLASGVPSRFSGSGSGTDFTLTISSLQPEDFATYYCAQGSGAPATFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205 - protein, 11 aa, Artificial Sequence
  G623_37 CDR-L1
RASQDVATAVA

SEQ ID NO: 206 - protein, 7 aa, Artificial Sequence
  G623_37 CDR-L2
AASYLYS

SEQ ID NO: 207 - protein, 9 aa, Artificial Sequence
  G623_37 CDR-L3
EQAFSNPLT

SEQ ID NO: 208 - protein, 214 aa, Artificial Sequence
  G623_37 LC
DIQMTQSPSSLSASVGDRVTITCRASQDVATAVAWYQQKPGKAPKLLIYAASYLYSGVPSRFSGSGSGTDFTLTISSLQPEDFATYYCEQAFSNPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 209 - protein, 11 aa, Artificial Sequence
  G623_23 CDR-L1
RASQAASAAVA

SEQ ID NO: 210 - protein, 7 aa, Artificial Sequence
  G623_23 CDR-L2
AASFLSS

SEQ ID NO: 211 - protein, 9 aa, Artificial Sequence
  G623_23 CDR-L3
AQGAAAPST

SEQ ID NO: 212 - protein, 214 aa, Artificial Sequence
  G623_23 LC
DIQMTQSPSSLSASVGDRVTITCRASQAASAAVAWYQQKPGKAPKLLIYAASFLSSGVPSRFSGSGSGTDFTLTISSLQPEDFATYYCAQGAAAPSTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 213 - protein, 11 aa, Artificial Sequence
  G623_89 CDR-L1
RASQDVATAVA

SEQ ID NO: 214 - protein, 7 aa, Artificial Sequence
  G623_89 CDR-L2
SASYLYS

SEQ ID NO: 215 - protein, 9 aa, Artificial Sequence
  G623_89 CDR-L3
QEGFSDPLT

SEQ ID NO: 216 - protein, 214 aa, Artificial Sequence
  G623_89 LC
DIQMTQSPSSLSASVGDRVTITCRASQDVATAVAWYQQKPGKAPKLLIYSASYLYSGVPSRFSGSGSGTDFTLTISSLQPEDFATYYCQEGFSDPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 217 - protein, 11 aa, Artificial Sequence
  G623_55 CDR-L1
RASPDVATGVA

SEQ ID NO: 218 - protein, 7 aa, Artificial Sequence
  G623_55 CDR-L2
SASFLYS

SEQ ID NO: 219 - protein, 9 aa, Artificial Sequence
  G623_55 CDR-L3
AQGAGAPAT

SEQ ID NO: 220 - protein, 214 aa, Artificial Sequence
  G623_55 LC
DIQMTQSPSSLSASVGDRVTITCRASPDVATGVAWYQQKPGKAPKLLIYSASFLYSGVPSRFSGSGSGTDFTLTISSLQPEDFATYYCAQGAGAPATFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 221 - protein, 11 aa, Artificial Sequence
  G623_34 CDR-L1
RASQEIASAVA

SEQ ID NO: 222 - protein, 7 aa, Artificial Sequence
  G623_34 CDR-L2
SASFLYS

SEQ ID NO: 223 - protein, 9 aa, Artificial Sequence
  G623_34 CDR-L3
EQAFSNPLT

SEQ ID NO: 224 - protein, 214 aa, Artificial Sequence
  G623_34 LC
DIQMTQSPSSLSASVGDRVTITCRASQEIASAVAWYQQKPGKAPKLLIYSASFLYSGVPSRFSGSGSGTDFTLTISSLQPEDFATYYCEQAFSNPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 225 - protein, 11 aa, Artificial Sequence
  G623_31 CDR-L1
RASPDVATAVA

SEQ ID NO: 226 - protein, 7 aa, Artificial Sequence
  G623_31 CDR-L2
AASFLYS

SEQ ID NO: 227 - protein, 9 aa, Artificial Sequence
  G623_31 CDR-L3
AQGYAAPAT

SEQ ID NO: 228 - protein, 214 aa, Artificial Sequence
  G623_31 LC
DIQMTQSPSSLSASVGDRVTITCRASPDVATAVAWYQQKPGKAPKLLIYAASFLYSGVPSRFSGSGSGTDFTLTISSLQPEDFATYYCAQGYAAPATFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 229 - protein, 11 aa, Artificial Sequence
  G623_62 CDR-L1
RASAAVAAAVA

SEQ ID NO: 230 - protein, 7 aa, Artificial Sequence
  G623_62 CDR-L2
AASFLSS

SEQ ID NO: 231 - protein, 9 aa, Artificial Sequence
  G623_62 CDR-L3
AQSSAAPPT

SEQ ID NO: 232 - protein, 214 aa, Artificial Sequence
  G623_62 LC
DIQMTQSPSSLSASVGDRVTITCRASAAVAAAVAWYQQKPGKAPKLLIYAASFLSSGVPSRFSGSGSGTDFTLTISSLQPEDFATYYCAQSSAAPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 233 - protein, 11 aa, Artificial Sequence
  G623_63 CDR-L1
RASPAASTAVA

SEQ ID NO: 234 - protein, 7 aa, Artificial Sequence
  G623_63 CDR-L2
AASFLYS

SEQ ID NO: 235 - protein, 9 aa, Artificial Sequence
  G623_63 CDR-L3
AQGYGTPST

SEQ ID NO: 236 - protein, 214 aa, Artificial Sequence
  G623_63 LC
DIQMTQSPSSLSASVGDRVTITCRASPAASTAVAWYQQKPGKAPKLLIYAASFLYSGVPSRFSGSGSGTDFTLTISSLQPEDFATYYCAQGYGTPSTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 237 - protein, 11 aa, Artificial Sequence
  G623_83 CDR-L1
RASQEISSAVA

SEQ ID NO: 238 - protein, 7 aa, Artificial Sequence
  G623_83 CDR-L2
SASFLYS

SEQ ID NO: 239 - protein, 9 aa, Artificial Sequence
  G623_83 CDR-L3
QEAYADPLT

SEQ ID NO: 240 - protein, 214 aa, Artificial Sequence
  G623_83 LC
DIQMTQSPSSLSASVGDRVTITCRASQEISSAVAWYQQKPGKAPKLLIYSASFLYSGVPSRFSGSGSGTDFTLTISSLQPEDFATYYCQEAYADPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 241 - protein, 11 aa, Artificial Sequence
  G623_64 CDR-L1
RASQDVSAAVA

SEQ ID NO: 242 - protein, 7 aa, Artificial Sequence
  G623_64 CDR-L2
SASFLAS

SEQ ID NO: 243 - protein, 9 aa, Artificial Sequence
  G623_64 CDR-L3
AQAAAAPST

SEQ ID NO: 244 - protein, 214 aa, Artificial Sequence
  G623_64 LC
DIQMTQSPSSLSASVGDRVTITCRASQDVSAAVAWYQQKPGKAPKLLIYSASFLASGVPSRFSGSGSGTDFTLTISSLQPEDFATYYCAQAAAAPSTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 245 - protein, 11 aa, Artificial Sequence
  G623_75 CDR-L1
RASQEVASAVA

SEQ ID NO: 246 - protein, 7 aa, Artificial Sequence
  G623_75 CDR-L2
AASYLFS

SEQ ID NO: 247 - protein, 9 aa, Artificial Sequence
  G623_75 CDR-L3
EQAFSNPLT

SEQ ID NO: 248 - protein, 214 aa, Artificial Sequence
  G623_75 LC
DIQMTQSPSSLSASVGDRVTITCRASQEVASAVAWYQQKPGKAPKLLIYAASYLFSGVPSRFSGSGSGTDFTLTISSLQPEDFATYYCEQAFSNPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 249 - protein, 11 aa, Artificial Sequence
  G623_27 CDR-L1
RASQEIASAVA

SEQ ID NO: 250 - protein, 7 aa, Artificial Sequence
  G623_27 CDR-L2
SASYLYS

SEQ ID NO: 251 - protein, 9 aa, Artificial Sequence
  G623_27 CDR-L3
QKAFSDPLT

SEQ ID NO: 252 - protein, 214 aa, Artificial Sequence
  G623_27 LC
DIQMTQSPSSLSASVGDRVTITCRASQEIASAVAWYQQKPGKAPKLLIYSASYLYSGVPSRFSGSGSGTDFTLTISSLQPEDFATYYCQKAFSDPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 253 - protein, 11 aa, Artificial Sequence
  G623_93 CDR-L1
RASQEVASAVA

SEQ ID NO: 254 - protein, 7 aa, Artificial Sequence
  G623_93 CDR-L2
SASYLFS

SEQ ID NO: 255 - protein, 9 aa, Artificial Sequence
  G623_93 CDR-L3
EQAFANPWT

SEQ ID NO: 256 - protein, 214 aa, Artificial Sequence
  G623_93 LC
DIQMTQSPSSLSASVGDRVTITCRASQEVASAVAWYQQKPGKAPKLLIYSASYLFSGVPSRFSGSGSGTDFTLTISSLQPEDFATYYCEQAFANPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 257 - protein, 11 aa, Artificial Sequence
  G623_53 CDR-L1
RASEAVSAAVA

SEQ ID NO: 258 - protein, 7 aa, Artificial Sequence
  G623_53 CDR-L2
AASFLSS

SEQ ID NO: 259 - protein, 9 aa, Artificial Sequence
  G623_53 CDR-L3
EQGAGAPGT

SEQ ID NO: 260 - protein, 214 aa, Artificial Sequence
  G623_53 LC
DIQMTQSPSSLSASVGDRVTITCRASEAVSAAVAWYQQKPGKAPKLLIYAASFLSSGVPSRFSGSGSGTDFTLTISSLQPEDFATYYCEQGAGAPGTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 261 - protein, 5 aa, Artificial Sequence
  G623 CDR-H1
DYWIH

SEQ ID NO: 262 - protein, 17 aa, Artificial Sequence
  G623 CDR-H2
GITPAGGYTYYADSVKG

SEQ ID NO: 263 - protein, 11 aa, Artificial Sequence
  G623 CDR-H3
FVFFLPYAMDY

SEQ ID NO: 264 - protein, 227 aa, Artificial Sequence; identical to SEQ ID NO: 31
  G623 HC

SEQ ID NO: 265 - protein, 5 aa, Artificial Sequence
  G623_15 CDR-H1
EYWIH

SEQ ID NO: 266 - protein, 17 aa, Artificial Sequence
  G623_15 CDR-H2
GITPAGGYSYYADSVKG

SEQ ID NO: 267 - protein, 11 aa, Artificial Sequence
  G623_15 CDR-H3
FVFFLPYAMDY

SEQ ID NO: 268 - protein, 227 aa, Artificial Sequence
  G623_15 HC
EVQLVESGGGLVQPGGSLRLSCAASGFTISEYWIHWVRQAPGKGLEWVAGITPAGGYSYYADSVKGRFTISADTSKNTAYLQMNSLRAEDTAVYYCARFVFFLPYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 269 - protein, 5 aa, Artificial Sequence
  G623_69 CDR-H1
EYWIH

SEQ ID NO: 270 - protein, 17 aa, Artificial Sequence
  G623_69 CDR-H2
GVTPAGGFSYYADSVKG

SEQ ID NO: 271 - protein, 11 aa, Artificial Sequence
  G623_69 CDR-H3
YVFFLPYAMDY

SEQ ID NO: 272 - protein, 227 aa, Artificial Sequence
  G623_69 HC
EVQLVESGGGLVQPGGSLRLSCAASGFTIAEYWIHWVRQAPGKGLEWVAGVTPAGGFSYYADSVKGRFTISADTSKNTAYLQMNSLRAEDTAVYYCARYVFFLPYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 273 - protein, 10 aa, Artificial Sequence
  YADS_1 HVL-H1
GFDISYYDIH

SEQ ID NO: 274 - protein, 17 aa, Artificial Sequence
  YADS_1 CDR-H2
SIAPYAGATYYADSVKG

SEQ ID NO: 275 - protein, 11 aa, Artificial Sequence
  YADS_1 CDR-H3
AADYAYDAMDY

SEQ ID NO: 276 - protein, 250 aa, Artificial Sequence
  YADS_1 HC
MKKNIAFLLASMFVFSIATNAYAEVQLVESGGGLVQPGGSLRLSCAASGFDISYYDIHWVRQAPGKGLEWVASIAPYAGATYYADSVKGRFTISADTSKNTAYLQMNSLRAEDTAVYYCSRAADYAYDAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 277 - protein, 10 aa, Artificial Sequence
  YADS_2 CDR-H1
GFNITYYSIH

SEQ ID NO: 278 - protein, 17 aa, Artificial Sequence
  YADS_2 CDR-H2
TISPTYGSTYYADSVKG

SEQ ID NO: 279 - protein, 11 aa, Artificial Sequence
  YADS_2 CDR-H3
SNNYSYYAMDY

SEQ ID NO: 280 - protein, 250 aa, Artificial Sequence
  YADS_2 HC
MKKNIAFLLASMFVFSIATNAYAEVQLVESGGGLVQPGGSLRLSCAASGFNITYYSIHWVRQAPGKGLEWVATISPTYGSTYYADSVKGRFTISADTSKNTAYLQMNSLRAEDTAVYYCSRSNNYSYYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 281 - protein, 10 aa, Artificial Sequence
  YADS_3 CDR-H1
GFSISDYDIH

SEQ ID NO: 282 - protein, 17 aa, Artificial Sequence
  YADS_3 CDR-H2
AIAPYSGYTYYADSVKG

SEQ ID NO: 283 - protein, 11 aa, Artificial Sequence
  YADS_3 CDR-H3
SSYAYYSAMDY

SEQ ID NO: 284 - protein, 250 aa, Artificial Sequence
  YADS_3 HC
MKKNIAFLLASMFVFSIATNAYAEVQLVESGGGLVQPGGSLRLSCAASGFSISDYDIHWVRQAPGKGLEWVAAIAPYSGYTYYADSVKGRFTISADTSKNTAYLQMNSLRAEDTAVYYCSRSSYAYYSAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 285 - protein, 10 aa, Artificial Sequence
  YADS_4 CDR-H1
GFNIYYYSIH

SEQ ID NO: 286 - protein, 17 aa, Artificial Sequence
  YADS_4 CDR-H2
TISPYYGTTYYADSVKG

SEQ ID NO: 287 - protein, 11 aa, Artificial Sequence
  YADS_4 CDR-H3
STNTNYYAMDY

SEQ ID NO: 288 - protein, 250 aa, Artificial Sequence
  YADS_4 HC
MKKNIAFLLASMFVFSIATNAYAEVQLVESGGGLVQPGGSLRLSCAASGFNIYYYSIHWVRQAPGKGLEWVATISPYYGTTYYADSVKGRFTISADTSKNTAYLQMNSLRAEDTAVYYCSRSTNTNYYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 289 - protein, 10 aa, Artificial Sequence
  YADS_5 CDR-H1
GFAISDYDIH

SEQ ID NO: 290 - protein, 17 aa, Artificial Sequence
  YADS_5 CDR-H2
AIAPYYGSTSYADSVKG

SEQ ID NO: 291 - protein, 11 aa, Artificial Sequence
  YADS_5 CDR-H3
SSYAYYAAMDY

SEQ ID NO: 292 - protein, 250 aa, Artificial Sequence
  YADS_5 HC
MKKNIAFLLASMFVFSIATNAYAEVQLVESGGGLVQPGGSLRLSCAASGFAISDYDIHWVRQAPGKGLEWVAAIAPYYGSTSYADSVKGRFTISADTSKNTAYLQMNSLRAEDTAVYYCSRSSYAYYAAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 293 - protein, 10 aa, Artificial Sequence
  YADS_6 CDR-H1
GFSIYDYDIH

SEQ ID NO: 294 - protein, 17 aa, Artificial Sequence
  YADS_6 CDR-H2
SIYPAYGSTAYADSVKG

SEQ ID NO: 295 - protein, 11 aa, Artificial Sequence
  YADS_6 CDR-H3
GAAYAYDAMDY

SEQ ID NO: 296 - protein, 250 aa, Artificial Sequence
  YADS_6 HC
MKKNIAFLLASMFVFSIATNAYAEVQLVESGGGLVQPGGSLRLSCAASGFSIYDYDIHWVRQAPGKGLEWVASIYPAYGSTAYADSVKGRFTISADTSKNTAYLQMNSLRAEDTAVYYCSRGAAYAYDAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 297 - protein, 10 aa, Artificial Sequence
  YADS_7 CDR-H1
GFSIDYYAIH

SEQ ID NO: 298 - protein, 17 aa, Artificial Sequence
  YADS_7 CDR-H2
SIAPYAGYTYYADSVKG

SEQ ID NO: 299 - protein, 11 aa, Artificial Sequence
  YADS_7 CDR-H3
AAAYYYDAMDY

SEQ ID NO: 300 - protein, 250 aa, Artificial Sequence
  YADS_7 HC
MKKNIAFLLASMFVFSIATNAYAEVQLVESGGGLVQPGGSLRLSCAASGFSIDYYAIHWVRQAPGKGLEWVASIAPYAGYTYYADSVKGRFTISADTSKNTAYLQMNSLRAEDTAVYYCSRAAAYYYDAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 301 - protein, 10 aa, Artificial Sequence
  YADS_8 CDR-H1
GFSIAYYDIH

SEQ ID NO: 302 - protein, 17 aa, Artificial Sequence
  YADS_8 CDR-H2
SIAPYAGATDYADSVKG

SEQ ID NO: 303 - protein, 11 aa, Artificial Sequence
  YADS_8 CDR-H3
SSYAYASAMDY

SEQ ID NO: 304 - protein, 250 aa, Artificial Sequence
  YADS_8 HC
MKKNIAFLLASMFVFSIATNAYAEVQLVESGGGLVQPGGSLRLSCAASGFSIAYYDIHWVRQAPGKGLEWVASIAPYAGATDYADSVKGRFTISADTSKNTAYLQMNSLRAEDTAVYYCSRSSYAYASAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 305 - protein, 10 aa, Artificial Sequence
  YADS_9 CDR-H1
GFDIYDYAIH

SEQ ID NO: 306 - protein, 17 aa, Artificial Sequence
  YADS_9 CDR-H2
SIAPYAGSTYYADSVKG

SEQ ID NO: 307 - protein, 11 aa, Artificial Sequence
  YADS_9 CDR-H3
DSYAYYAAMDY

SEQ ID NO: 308 - protein, 250 aa, Artificial Sequence
  YADS_9 HC
MKKNIAFLLASMFVFSIATNAYAEVQLVESGGGLVQPGGSLRLSCAASGFDIYDYAIHWVRQAPGKGLEWVASIAPYAGSTYYADSVKGRFTISADTSKNTAYLQMNSLRAEDTAVYYCSRDSYAYYAAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 309 - protein, 10 aa, Artificial Sequence
  YADS_10 CDR-H1
GFDISASDIH

SEQ ID NO: 310 - protein, 17 aa, Artificial Sequence
  YADS_10CDR-H2
SISPYAGYTAYADSVKG

SEQ ID NO: 311 - protein, 11 aa, Artificial Sequence
  YADS_10 CDR-H3
SAYYAASAMDY

SEQ ID NO: 312 - protein, 250 aa, Artificial Sequence
  YADS_10 HC
MKKNIAFLLASMFVFSIATNAYAEVQLVESGGGLVQPGGSLRLSCAASGFDISASDIHWVRQAPGKGLEWVASISPYAGYTAYADSVKGRFTISADTSKNTAYLQMNSLRAEDTAVYYCSRSAYYAASAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 313 - protein, 10 aa, Artificial Sequence
  YADS_11 CDR-H1
GFDIAYYDIH

SEQ ID NO: 314 - protein, 17 aa, Artificial Sequence
  YADS_11CDR-H2
SIAPYAGSTAYADSVKG

SEQ ID NO: 315 - protein, 11 aa, Artificial Sequence
  YADS_11 CDR-H3
AAAAYAYAMDY

SEQ ID NO: 316 - protein, 250 aa, Artificial Sequence
  YADS_11 HC
MKKNIAFLLASMFVFSIATNAYAEVQLVESGGGLVQPGGSLRLSCAASGFDIAYYDIHWVRQAPGKGLEWVASIAPYAGSTAYADSVKGRFTISADTSKNTAYLQMNSLRAEDTAVYYCSRAAAAYAYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 317 - protein, 10 aa, Artificial Sequence
  YADS_12 CDR-H1
GFAIDYYDIH

SEQ ID NO: 318 - protein, 17 aa, Artificial Sequence
  YADS_12CDR-H2
SIAPYAGSTYYADSVKG

SEQ ID NO: 319 - protein, 11 aa, Artificial Sequence
  YADS_12 CDR-H3
SAAYYAYAMDY

SEQ ID NO: 320 - protein, 250 aa, Artificial Sequence
  YADS_12 HC
MKKNIAFLLASMFVFSIATNAYAEVQLVESGGGLVQPGGSLRLSCAASGFAIDYYDIHWVRQAPGKGLEWVASIAPYAGSTYYADSVKGRFTISADTSKNTAYLQMNSLRAEDTAVYYCSRSAAYYAYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 321 - protein, 10 aa, Artificial Sequence
  YADS_13 CDR-H1
GFAIAYDDIH

SEQ ID NO: 322 - protein, 17 aa, Artificial Sequence
  YADS_13 CDR-H2
SIAPYAGATAYADSVKG

SEQ ID NO: 323 - protein, 11 aa, Artificial Sequence
  YADS_13 CDR-H3
AAAYAAYAMDY

SEQ ID NO: 324 - protein, 250 aa, Artificial Sequence
  YADS_13 HC
MKKNIAFLLASMFVFSIATNAYAEVQLVESGGGLVQPGGSLRLSCAASGFAIAYDDIHWVRQAPGKGLEWVASIAPYAGATAYADSVKGRFTISADTSKNTAYLQMNSLRAEDTAVYYCSRAAAYAAYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 325 - protein, 10 aa, Artificial Sequence
  YADS_14 CDR-H1
GFAIAAYDIH

SEQ ID NO: 326 - protein, 17 aa, Artificial Sequence
  YADS_14 CDR-H2
SISPYAGATSYADSVKG

SEQ ID NO: 327 - protein, 11 aa, Artificial Sequence
  YADS_14 CDR-H3
AAAYYYDAMDY

SEQ ID NO: 328 - protein, 250 aa, Artificial Sequence
  YADS_14 HC
MKKNIAFLLASMFVFSIATNAYAEVQLVESGGGLVQPGGSLRLSCAASGFAIAAYDIHWVRQAPGKGLEWVASISPYAGATSYADSVKGRFTISADTSKNTAYLQMNSLRAEDTAVYYCSRAAAYYYDAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 329 - protein, 10 aa, Artificial Sequence
  YADS_15 CDR-H1
GFYIADAAIH

SEQ ID NO: 330 - protein, 17 aa, Artificial Sequence
  YADS_15 CDR-H2
SIYPSAGATYYADSVKG

SEQ ID NO: 331 - protein, 11 aa, Artificial Sequence
  YADS_15 CDR-H3
AYDSDYYAMDY

SEQ ID NO: 332 - protein, 250 aa, Artificial Sequence
  YADS_15 HC
MKKNIAFLLASMFVFSIATNAYAEVQLVESGGGLVQPGGSLRLSCAASGFYIADAAIHWVRQAPGKGLEWVASIYPSAGATYYADSVKGRFTISADTSKNTAYLQMNSLRAEDTAVYYCSRAYDSDYYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 333 - protein, 10 aa, Artificial Sequence
  YADS_16 CDR-H1
GFAIYDYDIH

SEQ ID NO: 334 - protein, 17 aa, Artificial Sequence
  YADS_16 CDR-H2
DIAPYAGATAYADSVKG

SEQ ID NO: 335 - protein, 11 aa, Artificial Sequence
  YADS_16 CDR-H3
SSYAYYAAMDY

SEQ ID NO: 336 - protein, 250 aa, Artificial Sequence
  YADS_16 HC
MKKNIAFLLASMFVFSIATNAYAEVQLVESGGGLVQPGGSLRLSCAASGFAIYDYDIHWVRQAPGKGLEWVADIAPYAGATAYADSVKGRFTISADTSKNTAYLQMNSLRAEDTAVYYCSRSSYAYYAAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 337 - protein, 10 aa, Artificial Sequence
  YADS_17 CDR-H1
GFDIYDYSIH

SEQ ID NO: 338 - protein, 17 aa, Artificial Sequence
  YADS_17 CDR-H2
YISPYSGATAYADSVKG

SEQ ID NO: 339 - protein, 11 aa, Artificial Sequence
  YADS_17 CDR-H3
SSYAYYDAMDY

SEQ ID NO: 340 - protein, 250 aa, Artificial Sequence
  YADS_17 HC
MKKNIAFLLASMFVFSIATNAYAEVQLVESGGGLVQPGGSLRLSCAASGFDIYDYSIHWVRQAPGKGLEWVAYISPYSGATAYADSVKGRFTISADTSKNTAYLQMNSLRAEDTAVYYCSRSSYAYYDAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 341 - protein, 10 aa, Artificial Sequence
  YADS_18 CDR-H1
GFAIAAYAIH

SEQ ID NO: 342 - protein, 17 aa, Artificial Sequence
  YADS_18 CDR-H2
DIYPAAGDTAYADSVKG

SEQ ID NO: 343 - protein, 13 aa, Artificial Sequence
  YADS_18 CDR-H3
SYYYSYSSYAMDY

SEQ ID NO: 344 - protein, 252 aa, Artificial Sequence
  YADS_18 HC
MKKNIAFLLASMFVFSIATNAYAEVQLVESGGGLVQPGGSLRLSCAASGFAIAAYAIHWVRQAPGKGLEWVADIYPAAGDTAYADSVKGRFTISADTSKNTAYLQMNSLRAEDTAVYYCSRSYYYSYSSYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 345 - protein, 17 aa, Artificial Sequence
  YADS_19 CDR-H2
DIYPASGYTSYADSVKG

SEQ ID NO: 346 - protein, 12 aa, Artificial Sequence
  YADS_19 CDR-H3
AYDYYAAVAMDY

SEQ ID NO: 347 - protein, 10 aa, Artificial Sequence
  YADS_20 HVL-H1
GFDISAYAIH

SEQ ID NO: 348 - protein, 17 aa, Artificial Sequence
  YADS_20 CDR-H2
YISPSSGATAYADSVKG

SEQ ID NO: 349 - protein, 11 aa, Artificial Sequence
  YADS_20 CDR-H3
SAYYSYAAMDY

SEQ ID NO: 350 - protein, 250 aa, Artificial Sequence
  YADS_20 HC
MKKNIAFLLASMFVFSIATNAYAEVQLVESGGGLVQPGGSLRLSCAASGFDISAYAIHWVRQAPGKGLEWVAYISPSSGATAYADSVKGRFTISADTSKNTAYLQMNSLRAEDTAVYYCSRSAYYSYAAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 351 - protein, 17 aa, Artificial Sequence
  YADS_21 CDR-H2
SIAPYYGATAYADSVKG

SEQ ID NO: 352 - protein, 11 aa, Artificial Sequence
  YADS_21 CDR-H3
AAYSYYSAMDY

SEQ ID NO: 353 - protein, 16 aa, Artificial Sequence
  YADS_22 CDR-H2
SISPYSGYTAYADSVK

SEQ ID NO: 354 - protein, 12 aa, Artificial Sequence
  YADS_22 CDR-H3
AYYYYYYAAMDY

SEQ ID NO: 355 - protein, 10 aa, Artificial Sequence
  YADS_23 CDR-H1
GFDIYDDDIH

SEQ ID NO: 356 - protein, 17 aa, Artificial Sequence
  YADS_23 CDR-H2
YIAPSYGYTDYADSVKG

SEQ ID NO: 357 - protein, 13 aa, Artificial Sequence
  YADS_23 CDR-H3
SSDASYSYSAMDY

SEQ ID NO: 358 - protein, 252 aa, Artificial Sequence; identical to SEQ ID NO: 20
  YADS_23 HC

SEQ ID NO: 359 - protein, 17 aa, Artificial Sequence
  YADS_24 CDR-H2
SIYPSSGDTYYADSVKG

SEQ ID NO: 360 - protein, 12 aa, Artificial Sequence
  YADS_24 CDR-H3
DVSYSSYYAMDY

SEQ ID NO: 361 - protein, 11 aa, Artificial Sequence
  G6 CDR-L1
RASQDVSTAVA

SEQ ID NO: 362 - protein, 7 aa, Artificial Sequence
  G6 CDR-L2
SASFLYS

SEQ ID NO: 363 - protein, 9 aa, Artificial Sequence
  G6 CDR-L3
QQSYTTPPT

SEQ ID NO: 364 - protein, 214 aa, Artificial Sequence; identical to SEQ ID NO: 28
  G6 LC

SEQ ID NO: 365 - protein, 11 aa, Artificial Sequence
  G6_72 CDR-L1
RASQDVASSVA

SEQ ID NO: 366 - protein, 7 aa, Artificial Sequence
  G6_72 CDR-L2
AASFLYS

SEQ ID NO: 367 - protein, 9 aa, Artificial Sequence
  G6_72 CDR-L3
KQAFSSPPT

SEQ ID NO: 368 - protein, 214 aa, Artificial Sequence
  G6_72 LC
DIQMTQSPSSLSASVGDRVTITCRASQDVASSVAWYQQKPGKAPKLLIYAASFLYSGVPSRFSGSGSGTDFTLTISSLQPEDFATYYCKQAFSSPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 369 - protein, 11 aa, Artificial Sequence
  G6_14 CDR-L1
RASQDVATSVA

SEQ ID NO: 370 - protein, 7 aa, Artificial Sequence
  G6_14 CDR-L2
AASFLYS

SEQ ID NO: 371 - protein, 9 aa, Artificial Sequence
  G6_14 CDR-L3
EQAFTSPPT

SEQ ID NO: 372 - protein, 214 aa, Artificial Sequence
  G6_14 LC
DIQMTQSPSSLSASVGDRVTITCRASQDVATSVAWYQQKPGKAPKLLIYAASFLYSGVPSRFSGSGSGTDFTLTISSLQPEDFATYYCEQAFTSPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 373 - protein, 11 aa, Artificial Sequence
  G6_43 CDR-L1
RASQDVSSAVA

SEQ ID NO: 374 - protein, 7 aa, Artificial Sequence
  G6_43 CDR-L2
SASYLYS

SEQ ID NO: 375 - protein, 9 aa, Artificial Sequence
  G6_43 CDR-L3
QEAFTSPPT

SEQ ID NO: 376 - protein, 214 aa, Artificial Sequence
  G6_43 LC
DIQMTQSPSSLSASVGDRVTITCRASQDVSSAVAWYQQKPGKAPKLLIYSASYLYSGVPSRFSGSGSGTDFTLTISSLQPEDFATYYCQEAFTSPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 377 - protein, 11 aa, Artificial Sequence
  G6_54 CDR-L1
RASEEVATSVA

SEQ ID NO: 378 - protein, 7 aa, Artificial Sequence
  G6_54 CDR-L2
AASYLYS

SEQ ID NO: 379 - protein, 9 aa, Artificial Sequence
  G6_54 CDR-L3
EEAFTSPPT

SEQ ID NO: 380 - protein, 214 aa, Artificial Sequence
  G6_54 LC
DIQMTQSPSSLSASVGDRVTITCRASEEVATSVAWYQQKPGKAPKLLIYAASYLYSGVPSRFSGSGSGTDFTLTISSLQPEDFATYYCEEAFTSPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 381 - protein, 11 aa, Artificial Sequence
  G6_5 CDR-L1
RASQDVATAVA

SEQ ID NO: 382 - protein, 7 aa, Artificial Sequence
  G6_5 CDR-L2
SASYLYS

SEQ ID NO: 383 - protein, 9 aa, Artificial Sequence
  G6_5 CDR-L3
EEAYTSPPT

SEQ ID NO: 384 - protein, 214 aa, Artificial Sequence
  G6_5 LC
DIQMTQSPSSLSASVGDRVTITCRASQDVATAVAWYQQKPGKAPKLLIYSASYLYSGVPSRFSGSGSGTDFTLTISSLQPEDFATYYCEEAYTSPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 385 - protein, 11 aa, Artificial Sequence
  G6_44 CDR-L1
RASQDVASSVA

SEQ ID NO: 386 - protein, 7 aa, Artificial Sequence
  G6_44 CDR-L2
AASYLYS

SEQ ID NO: 387 - protein, 9 aa, Artificial Sequence
  G6_44 CDR-L3
QEAFTSPPT

SEQ ID NO: 388 - protein, 214 aa, Artificial Sequence
  G6_44 LC
DIQMTQSPSSLSASVGDRVTITCRASQDVASSVAWYQQKPGKAPKLLIYAASYLYSGVPSRFSGSGSGTDFTLTISSLQPEDFATYYCQEAFTSPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 389 - protein, 11 aa, Artificial Sequence
  G6_83 CDR-L1
RASQEVASAVA

SEQ ID NO: 390 - protein, 7 aa, Artificial Sequence
  G6_83 CDR-L2
SASFLYS

SEQ ID NO: 391 - protein, 9 aa, Artificial Sequence
  G6_83 CDR-L3
QQAYSSPAT

SEQ ID NO: 392 - protein, 214 aa, Artificial Sequence
  G6_83 LC
DIQMTQSPSSLSASVGDRVTITCRASQEVASAVAWYQQKPGKAPKLLIYSASFLYSGVPSRFSGSGSGTDFTLTISSLQPEDFATYYCQQAYSSPATFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 393 - protein, 11 aa, Artificial Sequence
  G6_78 CDR-L1
RASQDVSTAVA

SEQ ID NO: 394 - protein, 7 aa, Artificial Sequence
  G6_78 CDR-L2
SASFLYS

SEQ ID NO: 395 - protein, 9 aa, Artificial Sequence
  G6_78 CDR-L3
KQAFSSPPT

SEQ ID NO: 396 - protein, 214 aa, Artificial Sequence
  G6_78 LC
DIQMTQSPSSLSASVGDRVTITCRASQDVSTAVAWYQQKPGKAPKLLIYSASFLYSGVPSRFSGSGSGTDFTLTISSLQPEDFATYYCKQAFSSPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 397 - protein, 11 aa, Artificial Sequence
  G6_46 CDR-L1
RASEDISTAVA

SEQ ID NO: 398 - protein, 7 aa, Artificial Sequence
  G6_46 CDR-L2
SASFLFS

SEQ ID NO: 399 - protein, 9 aa, Artificial Sequence
  G6_46 CDR-L3
QQAFTTPPT

SEQ ID NO: 400 - protein, 214 aa, Artificial Sequence
  G6_46 LC
DIQMTQSPSSLSASVGDRVTITCRASEDISTAVAWYQQKPGKAPKLLIYSASFLFSGVPSRFSGSGSGTDFTLTISSLQPEDFATYYCQQAFTTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 401 - protein, 11 aa, Artificial Sequence
  G6_57 CDR-L1
RASQEISTSVA

SEQ ID NO: 402 - protein, 7 aa, Artificial Sequence
  G6_57 CDR-L2
AASYLYS

SEQ ID NO: 403 - protein, 9 aa, Artificial Sequence
  G6_57 CDR-L3
QQAFSSPPT

SEQ ID NO: 404 - protein, 214 aa, Artificial Sequence
  G6_57 LC
DIQMTQSPSSLSASVGDRVTITCRASQEISTSVAWYQQKPGKAPKLLIYAASYLYSGVPSRFSGSGSGTDFTLTISSLQPEDFATYYCQQAFSSPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 405 - protein, 11 aa, Artificial Sequence
  G6_61 CDR-L1
RASQDVASSVA

SEQ ID NO: 406 - protein, 7 aa, Artificial Sequence
  G6_61 CDR-L2
AASYLYS

SEQ ID NO: 407 - protein, 9 aa, Artificial Sequence
  G6_61 CDR-L3
EQAYSSPPT

SEQ ID NO: 408 - protein, 214 aa, Artificial Sequence
  G6_61 LC
DIQMTQSPSSLSASVGDRVTITCRASQDVASSVAWYQQKPGKAPKLLIYAASYLYSGVPSRFSGSGSGTDFTLTISSLQPEDFATYYCEQAYSSPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 409 - protein, 11 aa, Artificial Sequence
  G6_16 CDR-L1
RASEDVSTSVA

SEQ ID NO: 410 - protein, 7 aa, Artificial Sequence
  G6_16 CDR-L2
AASYLYS

SEQ ID NO: 411 - protein, 9 aa, Artificial Sequence
  G6_16 CDR-L3
EQAFTNPPT

SEQ ID NO: 412 - protein, 214 aa, Artificial Sequence
  G6_16 LC
DIQMTQSPSSLSASVGDRVTITCRASEDVSTSVAWYQQKPGKAPKLLIYAASYLYSGVPSRFSGSGSGTDFTLTISSLQPEDFATYYCEQAFTNPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 413 - protein, 11 aa, Artificial Sequence
  G6_71 CDR-L1
RASQDVATAVA

SEQ ID NO: 414 - protein, 7 aa, Artificial Sequence
  G6_71 CDR-L2
SASFLFS

SEQ ID NO: 415 - protein, 9 aa, Artificial Sequence
  G6_71 CDR-L3
EEAYTSPPT

SEQ ID NO: 416 - protein, 214 aa, Artificial Sequence
  G6_71 LC
DIQMTQSPSSLSASVGDRVTITCRASQDVATAVAWYQQKPGKAPKLLIYSASFLFSGVPSRFSGSGSGTDFTLTISSLQPEDFATYYCEEAYTSPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 417 - protein, 11 aa, Artificial Sequence
  G6_85 CDR-L1
RASEDIASSVA

SEQ ID NO: 418 - protein, 7 aa, Artificial Sequence
  G6_85 CDR-L2
AASYLFS

SEQ ID NO: 419 - protein, 9 aa, Artificial Sequence
  G6_85 CDR-L3
QQAFSSPPT

SEQ ID NO: 420 - protein, 214 aa, Artificial Sequence
  G6_85 LC
DIQMTQSPSSLSASVGDRVTITCRASEDIASSVAWYQQKPGKAPKLLIYAASYLFSGVPSRFSGSGSGTDFTLTISSLQPEDFATYYCQQAFSSPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 421 - protein, 11 aa, Artificial Sequence
  G6_58 CDR-L1
RASEEVSTAVA

SEQ ID NO: 422 - protein, 7 aa, Artificial Sequence
  G6_58 CDR-L2
AASFLYS

SEQ ID NO: 423 - protein, 9 aa, Artificial Sequence
  G6_58 CDR-L3
QQAFTSPAT

SEQ ID NO: 424 - protein, 214 aa, Artificial Sequence
  G6_58 LC
DIQMTQSPSSLSASVGDRVTITCRASEEVSTAVAWYQQKPGKAPKLLIYAASFLYSGVPSRFSGSGSGTDFTLTISSLQPEDFATYYCQQAFTSPATFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 425 - protein, 11 aa, Artificial Sequence
  G6_67 CDR-L1
RASQEISSSVA

SEQ ID NO: 426 - protein, 7 aa, Artificial Sequence
  G6_67 CDR-L2
SASYLYS

SEQ ID NO: 427 - protein, 9 aa, Artificial Sequence
  G6_67 CDR-L3
QEAFTTPPT

SEQ ID NO: 428 - protein, 214 aa, Artificial Sequence
  G6_67 LC
DIQMTQSPSSLSASVGDRVTITCRASQEISSSVAWYQQKPGKAPKLLIYSASYLYSGVPSRFSGSGSGTDFTLTISSLQPEDFATYYCQEAFTTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 429 - protein, 11 aa, Artificial Sequence
  G6_53 CDR-L1
RASEDIASSVA

SEQ ID NO: 430 - protein, 7 aa, Artificial Sequence
  G6_53 CDR-L2
SASYLYS

SEQ ID NO: 431 - protein, 9 aa, Artificial Sequence
  G6_53 CDR-L3
EESFSTPPT

SEQ ID NO: 432 - protein, 214 aa, Artificial Sequence
  G6_53 LC
DIQMTQSPSSLSASVGDRVTITCRASEDIASSVAWYQQKPGKAPKLLIYSASYLYSGVPSRFSGSGSGTDFTLTISSLQPEDFATYYCEESFSTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 433 - protein, 11 aa, Artificial Sequence
  G6_50 CDR-L1
RASQDISSSVA

SEQ ID NO: 434 - protein, 7 aa, Artificial Sequence
  G6_50 CDR-L2
AASFLYS

SEQ ID NO: 435 - protein, 9 aa, Artificial Sequence
  G6_50 CDR-L3
QQAFTSPPT

SEQ ID NO: 436 - protein, 214 aa, Artificial Sequence
  G6_50 LC
DIQMTQSPSSLSASVGDRVTITCRASQDISSSVAWYQQKPGKAPKLLIYAASFLYSGVPSRFSGSGSGTDFTLTISSLQPEDFATYYCQQAFTSPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 437 - protein, 11 aa, Artificial Sequence
  G6_56 CDR-L1
RASEDVSTSVA

SEQ ID NO: 438 - protein, 7 aa, Artificial Sequence
  G6_56 CDR-L2
AASYLYS

SEQ ID NO: 439 - protein, 9 aa, Artificial Sequence
  G6_56 CDR-L3
EEAFTTPPT

SEQ ID NO: 440 - protein, 214 aa, Artificial Sequence
  G6_56 LC
DIQMTQSPSSLSASVGDRVTITCRASEDVSTSVAWYQQKPGKAPKLLIYAASYLYSGVPSRFSGSGSGTDFTLTISSLQPEDFATYYCEEAFTTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 441 - protein, 11 aa, Artificial Sequence
  G6_32 CDR-L1
RASQDISSSVA

SEQ ID NO: 442 - protein, 7 aa, Artificial Sequence
  G6_32 CDR-L2
SASYLYS

SEQ ID NO: 443 - protein, 9 aa, Artificial Sequence
  G6_32 CDR-L3
KQSYSSPPT

SEQ ID NO: 444 - protein, 214 aa, Artificial Sequence
  G6_32 LC
DIQMTQSPSSLSASVGDRVTITCRASQDISSSVAWYQQKPGKAPKLLIYSASYLYSGVPSRFSGSGSGTDFTLTISSLQPEDFATYYCKQSYSSPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 445 - protein, 11 aa, Artificial Sequence
  G6_15 CDR-L1
RASEDISSAVA

SEQ ID NO: 446 - protein, 7 aa, Artificial Sequence
  G6_15 CDR-L2
SASFLYS

SEQ ID NO: 447 - protein, 9 aa, Artificial Sequence
  G6_15 CDR-L3
EEAYTSPPT

SEQ ID NO: 448 - protein, 214 aa, Artificial Sequence
  G6_15 LC
DIQMTQSPSSLSASVGDRVTITCRASEDISSAVAWYQQKPGKAPKLLIYSASFLYSGVPSRFSGSGSGTDFTLTISSLQPEDFATYYCEEAYTSPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 449 - protein, 11 aa, Artificial Sequence
  G6_62 CDR-L1
RASEEISSSVA

SEQ ID NO: 450 - protein, 7 aa, Artificial Sequence
  G6_62 CDR-L2
SASFLYS

SEQ ID NO: 451 - protein, 9 aa, Artificial Sequence
  G6_62 CDR-L3
EESFTTPPT

SEQ ID NO: 452 - protein, 214 aa, Artificial Sequence
  G6_62 LC
DIQMTQSPSSLSASVGDRVTITCRASEEISSSVAWYQQKPGKAPKLLIYSASFLYSGVPSRFSGSGSGTDFTLTISSLQPEDFATYYCEESFTTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 453 - protein, 11 aa, Artificial Sequence
  G6_64 CDR-L1
RASQEVATAVA

SEQ ID NO: 454 - protein, 7 aa, Artificial Sequence
  G6_64 CDR-L2
SASFLYS

SEQ ID NO: 455 - protein, 9 aa, Artificial Sequence
  G6_64 CDR-L3
QQAFSSPAT

SEQ ID NO: 456 - protein, 214 aa, Artificial Sequence
  G6_64 LC
DIQMTQSPSSLSASVGDRVTITCRASQEVATAVAWYQQKPGKAPKLLIFSASFLYSGVPSRFSGSGSGTDFTLTISSLQPEDFATYYCQQAFSSPATFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 457 - protein, 11 aa, Artificial Sequence
  G6_4 CDR-L1
RASEDVASAVA

SEQ ID NO: 458 - protein, 7 aa, Artificial Sequence
  G6_4 CDR-L2
AASYLYS

SEQ ID NO: 459 - protein, 9 aa, Artificial Sequence
  G6_4 CDR-L3
QESYSSPPT

SEQ ID NO: 460 - protein, 214 aa, Artificial Sequence
  G6_4 LC
DIQMTQSPSSLSASVGDRVTITCRASEDVASAVAWYQQKPGKAPKLLIYAASYLYSGVPSRFSGSGSGTDFTLTISSLQPEDFATYYCQESYSSPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 461 - protein, 11 aa, Artificial Sequence
  G6_25 CDR-L1
RASQDVSSSVA

SEQ ID NO: 462 - protein, 7 aa, Artificial Sequence
  G6_25 CDR-L2
AASYLYS

SEQ ID NO: 463 - protein, 9 aa, Artificial Sequence
  G6_25 CDR-L3
QEAFSSPAT

SEQ ID NO: 464 - protein, 214 aa, Artificial Sequence
  G6_25 LC
DIQMTQSPSSLSASVGDRVTITCRASQDVSSSVAWYQQKPGKAPKLLIYAASYLYSGVPSRFSGSGSGTDFTLTISSLQPEDFATYYCQEAFSSPATFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 465 - protein, 11 aa, Artificial Sequence
  G6_86 CDR-L1
RASQDIATSVA

SEQ ID NO: 466 - protein, 7 aa, Artificial Sequence
  G6_86 CDR-L2
AASFLFS

SEQ ID NO: 467 - protein, 9 aa, Artificial Sequence
  G6_86 CDR-L3
QQSYTNPPT

SEQ ID NO: 468 - protein, 214 aa, Artificial Sequence
  G6_86 LC
DIQMTQSPSSLSASVGDRVTITCRASQDIATSVAWYQQKPGKAPKLLIYAASFLFSGVPSRFSGSGSGTDFTLTISSLQPEDFATYYCQQSYTNPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 469 - protein, 11 aa, Artificial Sequence
  G6_74 CDR-L1
RASEEVASSVA

SEQ ID NO: 470 - protein, 7 aa, Artificial Sequence
  G6_74 CDR-L2
SASYLYS

SEQ ID NO: 471 - protein, 9 aa, Artificial Sequence
  G6_74 CDR-L3
QKAYSTPPT

SEQ ID NO: 472 - protein, 214 aa, Artificial Sequence
  G6_74 LC
DIQMTQSPSSLSASVGDRVTITCRASEEVASSVAWYQQKPGKAPKLLIYSASYLYSGVPSRFSGSGSGTDFTLTISSLQPEDFATYYCQKAYSTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 473 - protein, 10 aa, Artificial Sequence
  G6 CDR-H1
GFTISDYWIH

SEQ ID NO: 474 - protein, 17 aa, Artificial Sequence
  G6 CDR-H2
GITPAGGYTYYADSVKG

SEQ ID NO: 475 - protein, 11 aa, Artificial Sequence
  G6 CDR-H3
FVFFLPYAMDY

SEQ ID NO: 476 - protein, 227 aa, Artificial Sequence; identical to SEQ ID NO: 31
  G6 HC

SEQ ID NO: 477 - protein, 10 aa, Artificial Sequence
  G6_87 CDR-H1
GFTISDFWIH

SEQ ID NO: 478 - protein, 17 aa, Artificial Sequence
  G6_87 CDR-H2
GVTPAGGYSYYADSVKG

SEQ ID NO: 479 - protein, 11 aa, Artificial Sequence
  G6_87 CDR-H3
FVFFLPYAMDY

SEQ ID NO: 480 - protein, 227 aa, Artificial Sequence
  G6_87 HC
EVQLVESGGGLVQPGGSLRLSCAASGFTISDFWIHWVRQAPGKGLEWVAGVTPAGGYSYYADSVKGRFTISADTSKNTAYLQMNSLRAEDTAVYYCARFVFFLPYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 481 - protein, 10 aa, Artificial Sequence
  G6_88 CDR-H1
GFTIAEYWIH

SEQ ID NO: 482 - protein, 17 aa, Artificial Sequence
  G6_88 CDR-H2
GVTPAGGYTFYADSVKG

SEQ ID NO: 483 - protein, 11 aa, Artificial Sequence
  G6_88 CDR-H3
FVFFLPYAMDY

SEQ ID NO: 484 - protein, 227 aa, Artificial Sequence
  G6_88 HC
EVQLVESGGGLVQPGGSLRLSCAASGFTIAEYWIHWVRQAPGKGLEWVAGVTPAGGYTFYADSVKGRFTISADTSKNTAYLQMNSLRAEDTAVYYCARFVFFLPYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 485 - protein, 10 aa, Artificial Sequence
  G6_89 CDR-H1
GFTISDFWIH

SEQ ID NO: 486 - protein, 17 aa, Artificial Sequence
  G6_89 CDR-H2
GITAAGGFSYYADSVKG

SEQ ID NO: 487 - protein, 11 aa, Artificial Sequence
  G6_89 CDR-H3
FVFFLPYAMDY

SEQ ID NO: 488 - protein, 227 aa, Artificial Sequence
  G6_89 HC
EVQLVESGGGLVQPGGSLRLSCAASGFTISDFWIHWVRQAPGKGLEWVAGITAAGGFSYYADSVKGRFTISADTSKNTAYLQMNSLRAEDTAVYYCARFVFFLPYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 489 - protein, 11 aa, Artificial Sequence
  YADS1 CDR-L1
RASQASYSSVA

SEQ ID NO: 490 - protein, 7 aa, Artificial Sequence
  YADS1 CDR-L2
AASYLYS

SEQ ID NO: 491 - protein, 8 aa, Artificial Sequence
  YADS1 CDR-L3
QSSASPAT

SEQ ID NO: 492 - protein, 213 aa, Artificial Sequence; identical to SEQ ID NO: 19
  YADS1 LC

SEQ ID NO: 493 - protein, 11 aa, Artificial Sequence
  YADS2 CDR-L1
RASQSYAYAVA

SEQ ID NO: 494 - protein, 7 aa, Artificial Sequence
  YADS2 CDR-L2
DASYLYS

SEQ ID NO: 495 - protein, 9 aa, Artificial Sequence
  YADS2 CDR-L3
QQAYSSPDT

SEQ ID NO: 496 - protein, 214 aa, Artificial Sequence; identical to SEQ ID NO: 21
  YADS2 LC

SEQ ID NO: 497 - protein, 11 aa, Artificial Sequence
  YADS3 CDR-L1
RASQASYYDVA

SEQ ID NO: 498 - protein, 7 aa, Artificial Sequence
  YADS3 CDR-L2
AASYLYS

SEQ ID NO: 499 - protein, 9 aa, Artificial Sequence
  YADS3 CDR-L3
QQYYYAPAT

SEQ ID NO: 500 - protein, 214 aa, Artificial Sequence; identical to SEQ ID NO: 23
  YADS3 LC

SEQ ID NO: 501 - protein, 10 aa, Artificial Sequence
  YADS1 CDR -H1
GFDIYDDDIH

SEQ ID NO: 502 - protein, 17 aa, Artificial Sequence
  YADS1 CDR-H2
YIAPSYGYTDYADSVKG

SEQ ID NO: 503 - protein, 13 aa, Artificial Sequence
  YADS1 CDR-H3
SSDASYSYSAMDY

SEQ ID NO: 504 - protein, 252 aa, Artificial Sequence; identical to SEQ ID NO: 20
  YADS1 HC

SEQ ID NO: 505 - protein, 10 aa, Artificial Sequence
  YADS2 CDR -H1
GFAISDYDIH

SEQ ID NO: 506 - protein, 17 aa, Artificial Sequence
  YADS2 CDR-H2
DIAPYAGATAYADSVKG

SEQ ID NO: 507 - protein, 11 aa, Artificial Sequence
  YADS2 CDR-H3
SSYAYYAAMDY

SEQ ID NO: 508 - protein, 250 aa, Artificial Sequence; identical to SEQ ID NO: 22
  YADS2 HC

SEQ ID NO: 509 - protein, 10 aa, Artificial Sequence
  YADS3 CDR -H1
GFSISDYDIH

SEQ ID NO: 510 - protein, 17 aa, Artificial Sequence
  YADS3 CDR-H2
AIAPYSGSTYYADSVKG

SEQ ID NO: 511 - protein, 11 aa, Artificial Sequence
  YADS3 CDR-H3
SSYAYYSAMDY

SEQ ID NO: 512 - protein, 250 aa, Artificial Sequence; identical to SEQ ID NO: 24
  YADS3 HC

SEQ ID NO: 513 - protein, 10 aa, Artificial Sequence
  YADS4 CDR-H1
GFDIYDYAIH

SEQ ID NO: 514 - protein, 17 aa, Artificial Sequence
  YADS4 CDR-H2
SIAPYAGSTYYADSVKG

SEQ ID NO: 515 - protein, 11 aa, Artificial Sequence
  YADS4 CDR-H3
DSYAYYAAMDY

SEQ ID NO: 516 - protein, 250 aa, Artificial Sequence; identical to SEQ ID NO: 308
  YADS4 HC

SEQ ID NO: 517 - protein, 10 aa, Artificial Sequence
  YADS5 CDR -H1
GFSIAYYDIH

SEQ ID NO: 518 - protein, 17 aa, Artificial Sequence
  YADS5 CDR-H2
SIAPYAGATDYADSVKG

SEQ ID NO: 519 - protein, 11 aa, Artificial Sequence
  YADS5 CDR-H3
SSYAYASAMDY

SEQ ID NO: 520 - protein, 250 aa, Artificial Sequence; identical to SEQ ID NO: 304
  YADS5 HC

SEQ ID NO: 521 - protein, 10 aa, Artificial Sequence
  YADS6 CDR -H1
GFAIAYDDIH

SEQ ID NO: 522 - protein, 17 aa, Artificial Sequence
  YADS6 CDR-H2
SIAPYAGATAYADSVKG

SEQ ID NO: 523 - protein, 11 aa, Artificial Sequence
  YADS6 CDR-H3
AAAYAAYAMDY

SEQ ID NO: 524 - protein, 250 aa, Artificial Sequence; identical to SEQ ID NO: 324
  YADS6 HC

SEQ ID NO: 525 - protein, 10 aa, Artificial Sequence
  YADS7 CDR -H1
GFAIDYYDIH

SEQ ID NO: 526 - protein, 17 aa, Artificial Sequence
  YADS7 CDR-H2
SIAPYAGSTYYADSVKG

SEQ ID NO: 527 - protein, 11 aa, Artificial Sequence
  YADS7 CDR-H3
SAAYYAYAMDY

SEQ ID NO: 528 - protein, 250 aa, Artificial Sequence; identical to SEQ ID NO: 320
  YADS7 HC

SEQ ID NO: 529 - protein, 10 aa, Artificial Sequence
  YADS8 CDR -H1
GFAIAAYDIH

SEQ ID NO: 530 - protein, 17 aa, Artificial Sequence
  YADS8 CDR-H2
SISPYAGATSYADSVKG

SEQ ID NO: 531 - protein, 11 aa, Artificial Sequence
  YADS8 CDR-H3
AAAYYYDAMDY

SEQ ID NO: 532 - protein, 250 aa, Artificial Sequence; identical to SEQ ID NO: 328
  YADS8 HC

SEQ ID NO: 533 - protein, 10 aa, Artificial Sequence
  YADS9 CDR -H1
GFDISAYAIH

SEQ ID NO: 534 - protein, 17 aa, Artificial Sequence
  YADS9 CDR-H2
YISPSSGATAYADSVKG

SEQ ID NO: 535 - protein, 11 aa, Artificial Sequence
  YADS9 CDR-H3
SAYYSYAAMDY

SEQ ID NO: 536 - protein, 250 aa, Artificial Sequence; identical to SEQ ID NO: 350
  YADS9 HC

SEQ ID NO: 537 - protein, 10 aa, Artificial Sequence
  YADS10 CDR -H1
GFDIYDYSIH

SEQ ID NO: 538 - protein, 17 aa, Artificial Sequence
  YADS10 CDR-H2
YISPYSGATAYADSVKG

SEQ ID NO: 539 - protein, 11 aa, Artificial Sequence
  YADS10 CDR-H3
SSYAYYDAMDY

SEQ ID NO: 540 - protein, 250 aa, Artificial Sequence; identical to SEQ ID NO: 340
  YADS10 HC

SEQ ID NO: 541 - protein, 10 aa, Artificial Sequence
  YADS11 CDR -H1
GFDISASDIH

SEQ ID NO: 542 - protein, 17 aa, Artificial Sequence
  YADS11 CDR-H2
SISPYAGYTAYADSVKG

SEQ ID NO: 543 - protein, 11 aa, Artificial Sequence
  YADS11 CDR-H3
SAYYAASAMDY

SEQ ID NO: 544 - protein, 250 aa, Artificial Sequence; identical to SEQ ID NO: 312
  YADS11 HC

SEQ ID NO: 545 - protein, 10 aa, Artificial Sequence
  YADS12 CDR -H1
GFDIAYYDIH

SEQ ID NO: 546 - protein, 17 aa, Artificial Sequence
  YADS12 CDR-H2
SIAPYAGSTAYADSVKG

SEQ ID NO: 547 - protein, 11 aa, Artificial Sequence
  YADS12 CDR-H3
AAAAYAYAMDY

SEQ ID NO: 548 - protein, 250 aa, Artificial Sequence; identical to SEQ ID NO: 316
  YADS12 HC

SEQ ID NO: 549 - protein, 10 aa, Artificial Sequence
  YADS13 CDR -H1
GFSIDYYAIH

SEQ ID NO: 550 - protein, 17 aa, Artificial Sequence
  YADS13 CDR-H2
SIAPYAGYTYYADSVKG

SEQ ID NO: 551 - protein, 11 aa, Artificial Sequence
  YADS13 CDR-H3
AAAYYYDAMDY

SEQ ID NO: 552 - protein, 250 aa, Artificial Sequence; identical to SEQ ID NO: 300
  YADS13 HC

SEQ ID NO: 553 - protein, 10 aa, Artificial Sequence
  YADS14 CDR -H1
GFDISYYDIH

SEQ ID NO: 554 - protein, 17 aa, Artificial Sequence
  YADS14 CDR-H2
SIAPYAGATYYADSVKG

SEQ ID NO: 555 - protein, 11 aa, Artificial Sequence
  YADS14 CDR-H3
AADYAYDAMDY

SEQ ID NO: 556 - protein, 250 aa, Artificial Sequence; identical to SEQ ID NO: 276
  YADS14 HC

SEQ ID NO: 557 - protein, 10 aa, Artificial Sequence
  YADS15 CDR -H1
GFAIAAYAIH

SEQ ID NO: 558 - protein, 17 aa, Artificial Sequence
  YADS15 CDR-H2
DIYPAAGDTAYADSVKG

SEQ ID NO: 559 - protein, 13 aa, Artificial Sequence
  YADS15 CDR-H3
SYYYSYSSYAMDY

SEQ ID NO: 560 - protein, 252 aa, Artificial Sequence; identical to SEQ ID NO: 344
  YADS15 HC

SEQ ID NO: 561 - protein, 9 aa, Artificial Sequence
  YS1 Light chain CDR3
QQSYYSPYT

SEQ ID NO: 562 - protein, 9 aa, Artificial Sequence
  YS1 Heavy Chain CDR1
GFSISSSSI

SEQ ID NO: 563 - protein, 17 aa, Artificial Sequence
  YS1 Heavy chain CDR2
YISPSSGSTSYADSVKG

SEQ ID NO: 564 - protein, 12 aa, Artificial Sequence
  YS1 Heavy chain CDR3
YYSSSYYYSYYY

SEQ ID NO: 565 - protein, 214 aa, Artificial Sequence
  YS2 Fab light chain
DIQMTQSPSSLSASVGDRVTITCRASQSYAYAVAWYQQKPGKAPKLLIYDASYLYSGVPSRFSGSGSGTDFTLTISSLQPEDFATYYCQQSSYSPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 566 - protein, 8 aa, Artificial Sequence
  YS2 Heavy chain CDR1
GFSYYSSI

SEQ ID NO: 567 - protein, 12 aa, Artificial Sequence
  YS2 Heavy Chain CDR3
YYSSSSYYSYYY

SEQ ID NO: 568 - protein, 232 aa, Artificial Sequence
  YS2 Fab heavy chain
EVQLVESGGGLVQPGGSLRLSCAASGFSYYSSSIHWVRQAPGKGLEWVAYISPSSGSTSYADSVKGRFTISADTSKNTAYLQMNSLRAEDTAVYYCSRYYSSSSYYSYYYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 569 - protein, 9 aa, Artificial Sequence
  YS3 CDR3 light chain
QQSYYSPYT

SEQ ID NO: 570 - protein, 214 aa, Artificial Sequence; identical to SEQ ID NO: 42
  YS3 Fab light chain

SEQ ID NO: 571 - protein, 9 aa, Artificial Sequence
  YS3 CDR1 heavy chain
GFSSYSSSI

SEQ ID NO: 572 - protein, 16 aa, Artificial Sequence
  YS3 CDR2 heavy chain
YYSSSYSSSSSADSVK

SEQ ID NO: 573 - protein, 15 aa, Artificial Sequence
  CDR-H3
YSSYSSSSYYSSYYY

SEQ ID NO: 574 - protein, 234 aa, Artificial Sequence
  YS3 Fab heavy chain
EVQLVESGGGLVQPGGSLRLSCAASGFSSYSSSIHWVRQAPGKGLEWVAYYSSSYSSSSADSVKGRFTISADTSKNTAYLQMNSLRAEDTAVYYCSRYSSYSSSSYYSSYYYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 575 - protein, 15 aa, Artificial Sequence
  YS4 CDR3 heavy chain
YYYSYYSSSYSSYYY

SEQ ID NO: 576 - protein, 235 aa, Artificial Sequence
  YS4 Fab heavy chain
EVQLVESGGGLVQPGGSLRLSCAASGFSSSSSSIHWVRQAPGKGLEWVAYYSSYSSSSSSADSVKGRFTISADTSKNTAYLQMNSLRAEDTAVYYCSRYYYSYYSSSYSSYYYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 577 - protein, 9 aa, Artificial Sequence
  YS5 CDR3 light chain
QQSSYYPST

SEQ ID NO: 578 - protein, 214 aa, Artificial Sequence
  YS5 Fab light chain
DIQMTQSPSSLSASVGDRVTITCRASQSYAYAVAWYQQKPGKAPKLLIYDASYLYSGVPSRFSGSGSGTDFTLTISSLQPEDFATYYCQQSSYYPSTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 579 - protein, 15 aa, Artificial Sequence
  YS5 CDR3 heavy chain
YSSYSSSYSSYSYYY

SEQ ID NO: 580 - protein, 235 aa, Artificial Sequence
  YS5 Fab heavy chain
EVQLVESGGGLVQPGGSLRLSCAASGFSSSSSSIHWVRQAPGKGLEWVAYYSSSYSSSSSADSVKGRFTISADTSKNTAYLQMNSLRAEDTAVYYCSRYSSYSSSYSSYSYYYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 581 - protein, 15 aa, Artificial Sequence
  YS6 CDR3 heavy chain
YSSYSSYSSSYSYYY

SEQ ID NO: 582 - protein, 235 aa, Artificial Sequence
  YS6 Fab heavy chain
EVQLVESGGGLVQPGGSLRLSCAASGFSISYSSIHWVRQAPGKGLEWVAYISPSSGSTSYADSVKGRFTISADTSKNTAYLQMNSLRAEDTAVYYCSRYSSYSSYSSSYSYYYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 583 - protein, 9 aa, Artificial Sequence
  YS6 CDR3 light chain
QQSYYSPYT

SEQ ID NO: 584 - protein, 214 aa, Artificial Sequence; identical to SEQ ID NO: 42
  YS6 Fab light chain

SEQ ID NO: 585 - protein, 17 aa, Artificial Sequence
  YS7 CDR2 heavy chain
YISPYSGYTSYADSVKG

SEQ ID NO: 586 - protein, 9 aa, Artificial Sequence
  YS7 CDR3 light chain
QQSSYSPYT

SEQ ID NO: 587 - protein, 214 aa, Artificial Sequence; identical to SEQ ID NO: 565
  YS7 Fab light chain

SEQ ID NO: 588 - protein, 15 aa, Artificial Sequence
  YS7 CDR3 heavy chain
YSYSYSSSSSSSYYY

SEQ ID NO: 589 - protein, 235 aa, Artificial Sequence
  YS7 Fab heavy chain
EVQLVESGGGLVQPGGSLRLSCAASGFSISSSSIHWVRQAPGKGLEWVAYISPYSGYTSYADSVKGRFTISADTSKNTAYLQMNSLRAEDTAVYYCSRYSYSYSSSSSSSYYYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 590 - protein, 17 aa, Artificial Sequence
  YS8 CDR2 heavy chain
YISPSSGYTSYADSVKG

SEQ ID NO: 591 - protein, 15 aa, Artificial Sequence
  YS8 CDR3 heavy chain
YYSSYSSYSSYSYYY

SEQ ID NO: 592 - protein, 235 aa, Artificial Sequence
  YS8 Fab heavy chain
EVQLVESGGGLVQPGGSLRLSCAASGFSISSSSIHWVRQAPGKGLEWVAYISPSSGYTSYADSVKGRFTISADTSKNTAYLQMNSLRAEDTAVYYCSRYYSSYSSYSSYSYYYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 593 - protein, 14 aa, Artificial Sequence
  YS9  CDR3 heavy chain
YYSSYSYYSSSYYY

SEQ ID NO: 594 - protein, 234 aa, Artificial Sequence
  YS9 Fab heavy chain
EVQLVESGGGLVQPGGSLRLSCAASGFSISYSSIHWVRQAPGKGLEWVAYISPYSGSTSYADSVKGRFTISADTSKNTAYLQMNSLRAEDTAVYYCSRYYSSYSYYSSSYYYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 595 - protein, 9 aa, Artificial Sequence
  YS10 CDR-H3
QQSYSSPYI

SEQ ID NO: 596 - protein, 14 aa, Artificial Sequence
  YS10 CDR3 heavy chain
YSSYSYSSSYSYYY

SEQ ID NO: 597 - protein, 234 aa, Artificial Sequence
  YS10 Fab heavy chain
EVQLVESGGGLVQPGGSLRLSCAASGFSISSSSIHWVRQAPGKGLEWVAYISPSSGSTSYADSVKGRFTISADTSKNTAYLQMNSLRAEDTAVYYCSRYSSYSYSSSYSYYYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 598 - protein, 214 aa, Artificial Sequence
  YS10 Fab light chain
DIQMTQSPSSLSASVGDRVTITCRASQSYAYAVAWYQQKPGKAPKLLIYDASYLYSGVPSRFSGSGSGTDFTLTISSLQPEDFATYYCQQSYSSPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 599 - protein, 14 aa, Artificial Sequence
  YS11 CDR3 heavy chain
YSSSSYSSYSSYYY

SEQ ID NO: 600 - protein, 234 aa, Artificial Sequence
  YS11 Fab heavy chain
EVQLVESGGGLVQPGGSLRLSCAASGFSISSSSIHWVRQAPGKGLEWVAYISPSSGYTSYADSVKGRFTISADTSKNTAYLQMNSLRAEDTAVYYCSRYSSSSYSSYSSYYYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 601 - protein, 9 aa, Artificial Sequence
  YS12 CDR1 heavy chain
GFYISSSSI

SEQ ID NO: 602 - protein, 14 aa, Artificial Sequence
  YS12 CDR3 heavy chain
YSSSSSYYSSSYYY

SEQ ID NO: 603 - protein, 234 aa, Artificial Sequence
  YS12 Fab heavy chain
EVQLVESGGGLVQPGGSLRLSCAASGFYISSSSIHWVRQAPGKGLEWVAYISPSSGSTSYADSVKGRFTISADTSKNTAYLQMNSLRAEDTAVYYCSRYSSSSSYYSSSYYYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 604 - protein, 14 aa, Artificial Sequence
  YS13 CDR3 heavy chain
YSYSSSSYYYSYYY

SEQ ID NO: 605 - protein, 234 aa, Artificial Sequence
  YS13 Fab heavy chain
EVQLVESGGGLVQPGGSLRLSCAASGFSISSSSIHWVRQAPGKGLEWVAYISPSSGSTSYADSVKGRFTISADTSKNTAYLQMNSLRAEDTAVYYCSRYSYSSSSYYYSYYYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 606 - protein, 14 aa, Artificial Sequence
  YS14 CDR3 heavy chain
YSSSSYSSYYSYYY

SEQ ID NO: 607 - protein, 234 aa, Artificial Sequence
  YS14 Fab heavy chain
EVQLVESGGGLVQPGGSLRLSCAASGFSISSSSIHWVRQAPGKGLEWVAYISPYSGSTSYADSVKGRFTISADTSKNTAYLQMNSLRAEDTAVYYCSRYSSSSYSSYYSYYYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 608 - protein, 9 aa, Artificial Sequence
  YS15 CDR3 light chain
QQSYSYPST

SEQ ID NO: 609 - protein, 214 aa, Artificial Sequence
  YS15 Fab light chain
DIQMTQSPSSLSASVGDRVTITCRASQSYAYAVAWYQQKPGKAPKLLIYDASYLYSGVPSRFSGSGSGTDFTLTISSLQPEDFATYYCQQSYSYPSTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 610 - protein, 17 aa, Artificial Sequence
  YS15 CDR2 heavy chain
YISPYSGSTYYADSVKG

SEQ ID NO: 611 - protein, 14 aa, Artificial Sequence
  YS15 CDR3 heavy chain
YSSYSYSSSYSYYY

SEQ ID NO: 612 - protein, 234 aa, Artificial Sequence
  YS15 Fab heavy chain
EVQLVESGGGLVQPGGSLRLSCAASGFSISSSSIHWVRQAPGKGLEWVAYISPYSGSTYYADSVKGRFTISADTSKNTAYLQMNSLRAEDTAVYYCSRYSSYSYSSSYSYYYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 613 - protein, 14 aa, Artificial Sequence
  YS16 CDR3 heavy chain
YSYYSYSSYSSYYY

SEQ ID NO: 614 - protein, 234 aa, Artificial Sequence
  YS16 Fab heavy chain
EVQLVESGGGLVQPGGSLRLSCAASGFSISSSSIHWVRQAPGKGLEWVAYISPYSGSTYYADSVKGRFTISADTSKNTAYLQMNSLRAEDTAVYYCSRYSYYSYSSYSSYYYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 615 - protein, 9 aa, Artificial Sequence
  YS17 CDR3 light chain
QQSYYYPST

SEQ ID NO: 616 - protein, 214 aa, Artificial Sequence
  YS17 Fab light chain
DIQMTQSPSSLSASVGDRVTITCRASQSYAYAVAWYQQKPGKAPKLLIYDASYLYSGVPSRFSGSGSGTDFTLTISSLQPEDFATYYCQQSYYYPSTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 617 - protein, 17 aa, Artificial Sequence
  YS17 CDR2 heavy chain
SISPYYGYTSYADSVKG

SEQ ID NO: 618 - protein, 14 aa, Artificial Sequence
  YS17 CDR3 heavy chain
YSSYSSYSSYSYYY

SEQ ID NO: 619 - protein, 234 aa, Artificial Sequence
  YS17 Fab heavy chain
EVQLVESGGGLVQPGGSLRLSCAASGFSISSSSIHWVRQAPGKGLEWVASISPYYGYTSYADSVKGRFTISADTSKNTAYLQMNSLRAEDTAVYYCSRYSSYSSYSSYSYYYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 620 - protein, 9 aa, Artificial Sequence
  YS18 CDR1 heavy chain
GFSIYSSSI

SEQ ID NO: 621 - protein, 14 aa, Artificial Sequence
  YS18 CDR3 heavy chain
YSYSSSSSYSSYYY

SEQ ID NO: 622 - protein, 234 aa, Artificial Sequence
  YS18 Fab heavy chain
EVQLVESGGGLVQPGGSLRLSCAASGFSIYSSSIHWVRQAPGKGLEWVAYISPYSGSTSYADSVKGRFTISADTSKNTAYLQMNSLRAEDTAVYYCSRYSYSSSSSYSSYYYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 623 - protein, 14 aa, Artificial Sequence
  YS19 CDR3 heavy chain
YSSSYYSSYSSYYY

SEQ ID NO: 624 - protein, 234 aa, Artificial Sequence
  YS19 Fab heavy chain
EVQLVESGGGLVQPGGSLRLSCAASGFSISSSSIHWVRQAPGKGLEWVAYISPYSGYTSYADSVKGRFTISADTSKNTAYLQMNSLRAEDTAVYYCSRYSSSYYSSYSSYYYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 625 - protein, 14 aa, Artificial Sequence
  YS20 CDR3 heavy chain
YSYSSSSSYSSYYY

SEQ ID NO: 626 - protein, 234 aa, Artificial Sequence
  YS20 Fab heavy chain
EVQLVESGGGLVQPGGSLRLSCAASGFSISSSSIHWVRQAPGKGLEWVAYISPYSGSTSYADSVKGRFTISADTSKNTAYLQMNSLRAEDTAVYYCSRYSYSSSSSYSSYYYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 627 - protein, 17 aa, Artificial Sequence
  YS21 CDR2 heavy chain
YISPSSGSTSYADSVKG

SEQ ID NO: 628 - protein, 14 aa, Artificial Sequence
  YS21 CDR3 heavy chain
YSYYSYSSYYSYYY

SEQ ID NO: 629 - protein, 234 aa, Artificial Sequence
  YS21 Fab heavy chain
EVQLVESGGGLVQPGGSLRLSCAASGFYISSSSIHWVRQAPGKGLEWVAYISPSSGSTSYADSVKGRFTISADTSKNTAYLQMNSLRAEDTAVYYCSRYSYYSYSSYYSYYYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 630 - protein, 9 aa, Artificial Sequence
  YS22 CDR3 light chain
QQSSSSPYT

SEQ ID NO: 631 - protein, 214 aa, Artificial Sequence
  YS22 Fab light chain
DIQMTQSPSSLSASVGDRVTITCRASQSYAYAVAWYQQKPGKAPKLLIYDASYLYSGVPSRFSGSGSGTDFTLTISSLQPEDFATYYCQQSSSSPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 632 - protein, 14 aa, Artificial Sequence
  YS22 CDR3 heavy chain
YYSSSYSYSSSYYY

SEQ ID NO: 633 - protein, 234 aa, Artificial Sequence
  YS22 Fab heavy chain
EVQLVESGGGLVQPGGSLRLSCAASGFSIYSSSIHWVRQAPGKGLEWVAYISPYSGYTSYADSVKGRFTISADTSKNTAYLQMNSLRAEDTAVYYCSRYYSSSYSYSSSYYYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 634 - protein, 14 aa, Artificial Sequence
  YS23 CDR3 heavy chain
YYYSYYSSSYSYYY

SEQ ID NO: 635 - protein, 234 aa, Artificial Sequence
  YS23 Fab heavy chain
EVQLVESGGGLVQPGGSLRLSCAASGFSISSSSIHWVRQAPGKGLEWVAYISPYSGYTSYADSVKGRFTISADTSKNTAYLQMNSLRAEDTAVYYCSRYYYSYYSSSYSYYYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 636 - protein, 14 aa, Artificial Sequence
  YS24 CDR3 heavy chain
YYSYSSYSSSSYYY

SEQ ID NO: 637 - protein, 234 aa, Artificial Sequence
  YS24 Fab heavy chain
EVQLVESGGGLVQPGGSLRLSCAASGFSISSSSIHWVRQAPGKGLEWVAYISPSSGSTSYADSVKGRFTISADTSKNTAYLQMNSLRAEDTAVYYCSRYYSYSSYSSSSYYYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 638 - protein, 14 aa, Artificial Sequence
  YS25 CDR3 heavy chain
YYSSSYSSYSSYYY

SEQ ID NO: 639 - protein, 234 aa, Artificial Sequence
  YS25 Fab heavy chain
EVQLVESGGGLVQPGGSLRLSCAASGFSIYYSSIHWVRQAPGKGLEWVAYISPSSGSTSYADSVKGRFTISADTSKNTAYLQMNSLRAEDTAVYYCSRYYSSSYSSYSSYYYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 640 - protein, 13 aa, Artificial Sequence
  YS26 CDR3 heavy chain
YSYSSSSSYSYYY

SEQ ID NO: 641 - protein, 233 aa, Artificial Sequence
  YS26 Fab heavy chain
EVQLVESGGGLVQPGGSLRLSCAASGFSISSSSIHWVRQAPGKGLEWVAYISPYSGSTSYADSVKGRFTISADTSKNTAYLQMNSLRAEDTAVYYCSRYSYSSSSSYSYYYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 642 - protein, 17 aa, Artificial Sequence
  YS27 CDR2 heavy chain
SISPYSGYTSYADSVKG

SEQ ID NO: 643 - protein, 13 aa, Artificial Sequence
  YS27 CDR3 heavy chain
YSSSSYSYSSYYY

SEQ ID NO: 644 - protein, 233 aa, Artificial Sequence
  YS27 Fab heavy chain
EVQLVESGGGLVQPGGSLRLSCAASGFSIYYSSIHWVRQAPGKGLEWVASISPYSGYTSYADSVKGRFTISADTSKNTAYLQMNSLRAEDTAVYYCSRYSSSSYSYSSYYYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 645 - protein, 17 aa, Artificial Sequence
  YS28 CDR2 heavy chain
YISPSYGSTSYADSVKG

SEQ ID NO: 646 - protein, 13 aa, Artificial Sequence
  YS28 CDR3 heavy chain
YYSSSYSYYSYYY

SEQ ID NO: 647 - protein, 233 aa, Artificial Sequence
  YS28 Fab heavy chain
EVQLVESGGGLVQPGGSLRLSCAASGFSISSSSIHWVRQAPGKGLEWVAYISPSYGSTSYADSVKGRFTISADTSKNTAYLQMNSLRAEDTAVYYCSRYYSSSYSYYSYYYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 648 - protein, 13 aa, Artificial Sequence
  YS29 CDR3 heavy chain
YSSSSSSYYSYYY

SEQ ID NO: 649 - protein, 233 aa, Artificial Sequence
  YS29 Fab heavy chain
EVQLVESGGGLVQPGGSLRLSCAASGFSISSSSIHWVRQAPGKGLEWVAYISPYSGYTSYADSVKGRFTISADTSKNTAYLQMNSLRAEDTAVYYCSRYSSSSSSYYSYYYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 650 - protein, 13 aa, Artificial Sequence
  YS30 CDR3 heavy chain
YSSSYYSSYSYYY

SEQ ID NO: 651 - protein, 233 aa, Artificial Sequence
  YS30 Fab heavy chain
EVQLVESGGGLVQPGGSLRLSCAASGFSISSSSIHWVRQAPGKGLEWVAYISPSSGSTSYADSVKGRFTISADTSKNTAYLQMNSLRAEDTAVYYCSRYSSSYYSSYSYYYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 652 - protein, 13 aa, Artificial Sequence
  YS31 CDR3 heavy chain
YSSSSYSYSSYYY

SEQ ID NO: 653 - protein, 233 aa, Artificial Sequence
  YS31 Fab heavy chain
EVQLVESGGGLVQPGGSLRLSCAASGFSIYSSSIHWVRQAPGKGLEWVAYISPSSGSTSYADSVKGRFTISADTSKNTAYLQMNSLRAEDTAVYYCSRYSSSSYSYSSYYYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 654 - protein, 13 aa, Artificial Sequence
  YS32 CDR3 heavy chain
YYSSSSSYYSYYY

SEQ ID NO: 655 - protein, 233 aa, Artificial Sequence
  YS32 Fab heavy chain
EVQLVESGGGLVQPGGSLRLSCAASGFSIYSSSIHWVRQAPGKGLEWVAYISPSSGSTSYADSVKGRFTISADTSKNTAYLQMNSLRAEDTAVYYCSRYYSSSSSYYSYYYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 656 - protein, 13 aa, Artificial Sequence
  YS33 CDR3 heavy chain
YSSYSSSYSSYYY

SEQ ID NO: 657 - protein, 233 aa, Artificial Sequence
  YS33 Fab heavy chain
EVQLVESGGGLVQPGGSLRLSCAASGFYISSSSIHWVRQAPGKGLEWVAYISPSSGYTSYADSVKGRFTISADTSKNTAYLQMNSLRAEDTAVYYCSRYSSYSSSYSSYYYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 658 - protein, 13 aa, Artificial Sequence
  YS34 CDR3 heavy chain
YSSSSYSSSSYYY

SEQ ID NO: 659 - protein, 233 aa, Artificial Sequence
  YS34 Fab heavy chain
EVQLVESGGGLVQPGGSLRLSCAASGFSISSSSIHWVRQAPGKGLEWVAYISPYSGSTSYADSVKGRFTISADTSKNTAYLQMNSLRAEDTAVYYCSRYSSSSYSSSSYYYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 660 - protein, 13 aa, Artificial Sequence
  YS35 CDR3 heavy chain
YSSSSYSYSSYYY

SEQ ID NO: 661 - protein, 233 aa, Artificial Sequence
  YS35 Fab heavy chain
EVQLVESGGGLVQPGGSLRLSCAASGFSISSSSIHWVRQAPGKGLEWVAYISPSSGSTSYADSVKGRFTISADTSKNTAYLQMNSLRAEDTAVYYCSRYSSSSYSYSSYYYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 662 - protein, 9 aa, Artificial Sequence
  YS36 CDR1 heavy chain
GFSIYSSSI

SEQ ID NO: 663 - protein, 13 aa, Artificial Sequence
  YS36 CDR3 heavy chain
YSSSSSSYSSYYY

SEQ ID NO: 664 - protein, 233 aa, Artificial Sequence
  YS36 Fab heavy chain
EVQLVESGGGLVQPGGSLRLSCAASGFSIYSSSIHWVRQAPGKGLEWVAYISPYSGSTYYADSVKGRFTISADTSKNTAYLQMNSLRAEDTAVYYCSRYSSSSSSYSSYYYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 665 - protein, 13 aa, Artificial Sequence
  YS37 CDR3 heavy chain
YYSSSSSYSSYYY

SEQ ID NO: 666 - protein, 233 aa, Artificial Sequence
  YS37 Fab heavy chain
EVQLVESGGGLVQPGGSLRLSCAASGFSISSSSIHWVRQAPGKGLEWVAYISPYSGSTYYADSVKGRFTISADTSKNTAYLQMNSLRAEDTAVYYCSRYYSSSSSYSSYYYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 667 - protein, 13 aa, Artificial Sequence
  YS38 CDR3 heavy chain
YSYSSYSSYSSYY

SEQ ID NO: 668 - protein, 233 aa, Artificial Sequence
  YS38 Fab heavy chain
EVQLVESGGGLVQPGGSLRLSCAASGFSIYSSSIHWVRQAPGKGLEWVAYISPSSGSTSYADSVKGRFTISADTSKNTAYLQMNSLRAEDTAVYYCSRYSYSSYSSYSSYYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 669 - protein, 12 aa, Artificial Sequence
  YS39 CDR3 heavy chain
YYSSSYSYSYYY

SEQ ID NO: 670 - protein, 232 aa, Artificial Sequence
  YS39 Fab heavy chain
EVQLVESGGGLVQPGGSLRLSCAASGFSIYSSSIHWVRQAPGKGLEWVAYISPYSGSTSYADSVKGRFTISADTSKNTAYLQMNSLRAEDTAVYYCSRYYSSSYSYSYYYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 671 - protein, 12 aa, Artificial Sequence
  YS40 CDR3 heavy chain
YYYSYSSYSYYY

SEQ ID NO: 672 - protein, 232 aa, Artificial Sequence
  YS40 Fab heavy chain
EVQLVESGGGLVQPGGSLRLSCAASGFSIYSSSIHWVRQAPGKGLEWVAYISPSSGSTSYADSVKGRFTISADTSKNTAYLQMNSLRAEDTAVYYCSRYYYSYSSYSYYYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 673 - protein, 12 aa, Artificial Sequence
  YS41 CDR3 heavy chain
YSYSYSSYSYYY

SEQ ID NO: 674 - protein, 232 aa, Artificial Sequence
  YS41 Fab heavy chain
EVQLVESGGGLVQPGGSLRLSCAASGFSISSSSIHWVRQAPGKGLEWVAYISPSSGSTSYADSVKGRFTISADTSKNTAYLQMNSLRAEDTAVYYCSRYSYSYSSYSYYYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 675 - protein, 12 aa, Artificial Sequence
  YS42 CDR3 heavy chain
YSSSSSYSSYYY

SEQ ID NO: 676 - protein, 232 aa, Artificial Sequence
  YS42 Fab heavy chain
EVQLVESGGGLVQPGGSLRLSCAASGFSISYSSIHWVRQAPGKGLEWVAYISPYSGSTSYADSVKGRFTISADTSKNTAYLQMNSLRAEDTAVYYCSRYSSSSSYSSYYYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 677 - protein, 12 aa, Artificial Sequence
  YS43 CDR3 heavy chain
YSSSSYYYSYYY

SEQ ID NO: 678 - protein, 232 aa, Artificial Sequence
  YS43 Fab heavy chain
EVQLVESGGGLVQPGGSLRLSCAASGFSISSSSIHWVRQAPGKGLEWVAYISPYSGSTSYADSVKGRFTISADTSKNTAYLQMNSLRAEDTAVYYCSRYSSSSYYYSYYYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 679 - protein, 12 aa, Artificial Sequence
  YS44 CDR3 heavy chain
YSSSSSYYSYYY

SEQ ID NO: 680 - protein, 232 aa, Artificial Sequence
  YS44 Fab heavy chain
EVQLVESGGGLVQPGGSLRLSCAASGFSIYSSSIHWVRQAPGKGLEWVAYISPSSGSTSYADSVKGRFTISADTSKNTAYLQMNSLRAEDTAVYYCSRYSSSSSYYSYYYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 681 - protein, 12 aa, Artificial Sequence
  YS45 CDR3 heavy chain
YSSYSYYYSYYY

SEQ ID NO: 682 - protein, 232 aa, Artificial Sequence
  YS45 Fab heavy chain
EVQLVESGGGLVQPGGSLRLSCAASGFSISSSSIHWVRQAPGKGLEWVASISPYSGYTSYADSVKGRFTISADTSKNTAYLQMNSLRAEDTAVYYCSRYSSYSYYYSYYYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 683 - protein, 12 aa, Artificial Sequence
  YS47 CDR3 heavy chain
YSSSSYSYSYYY

SEQ ID NO: 684 - protein, 232 aa, Artificial Sequence
  YS47 Fab heavy chain
EVQLVESGGGLVQPGGSLRLSCAASGFSIYSSSIHWVRQAPGKGLEWVAYISPSSGYTSYADSVKGRFTISADTSKNTAYLQMNSLRAEDTAVYYCSRYSSSSYSYSYYYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 685 - protein, 12 aa, Artificial Sequence
  YS47 CDR3 heavy chain
YSSSYSSYSYYY

SEQ ID NO: 686 - protein, 232 aa, Artificial Sequence
  YS47 Fab heavy chain
EVQLVESGGGLVQPGGSLRLSCAASGFSISSSSIHWVRQAPGKGLEWVAYISPYSGSTSYADSVKGRFTISADTSKNTAYLQMNSLRAEDTAVYYCSRYSSSYSSYSYYYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 687 - protein, 12 aa, Artificial Sequence
  YS48 CDR3 heavy chain
YSYSSSSSSYYY

SEQ ID NO: 688 - protein, 232 aa, Artificial Sequence
  YS48 Fab heavy chain
EVQLVESGGGLVQPGGSLRLSCAASGFSISSSSIHWVRQAPGKGLEWVAYISPYSGYTSYADSVKGRFTISADTSKNTAYLQMNSLRAEDTAVYYCSRYSYSSSSSSYYYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 689 - protein, 12 aa, Artificial Sequence
  YS49 CDR3 heavy chain
YSSSYYYYSYSY

SEQ ID NO: 690 - protein, 232 aa, Artificial Sequence
  YS49 Fab heavy chain
EVQLVESGGGLVQPGGSLRLSCAASGFSIYSSSIHWVRQAPGKGLEWVAYISPYSGSTSYADSVKGRFTISADTSKNTAYLQMNSLRAEDTAVYYCSRYSSSYYYYSYSYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 691 - protein, 11 aa, Artificial Sequence
  YS50 CDR3 heavy chain
YSSSYYYSYYY

SEQ ID NO: 692 - protein, 231 aa, Artificial Sequence
  YS50 Fab heavy chain
EVQLVESGGGLVQPGGSLRLSCAASGFSISSSSIHWVRQAPGKGLEWVAYISPSSGSTSYADSVKGRFTISADTSKNTAYLQMNSLRAEDTAVYYCSRYSSSYYYSYYYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 693 - protein, 11 aa, Artificial Sequence
  YS51 CDR3 heavy chain
YSSSYSYSYYY

SEQ ID NO: 694 - protein, 231 aa, Artificial Sequence
  YS51 Fab heavy chain
EVQLVESGGGLVQPGGSLRLSCAASGFSISSSSIHWVRQAPGKGLEWVAYISPYSGSTSYADSVKGRFTISADTSKNTAYLQMNSLRAEDTAVYYCSRYSSSYSYSYYYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 695 - protein, 9 aa, Artificial Sequence
  YS52 CDR1 heavy chain
GFSISSSYI

SEQ ID NO: 696 - protein, 17 aa, Artificial Sequence
  YS52 CDR2 heavy chain
SIYPYYGYTSYADSVKG

SEQ ID NO: 697 - protein, 8 aa, Artificial Sequence
  YS52 CDR3 heavy chain
SSSSSYYS

SEQ ID NO: 698 - protein, 228 aa, Artificial Sequence
  YS52 Fab heavy chain
EVQLVESGGGLVQPGGSLRLSCAASGFSISSSYIHWVRQAPGKGLEWVASIYPYYGYTSYADSVKGRFTISADTSKNTAYLQMNSLRAEDTAVYYCSRSSSSSYYSAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 699 - protein, 17 aa, Artificial Sequence
  YS53 CDRH2
SISPYSGYTYYADSVKG

SEQ ID NO: 700 - protein, 13 aa, Artificial Sequence
  YS53 CDRH3
SYYSSSYSSYYSS

SEQ ID NO: 701 - protein, 233 aa, Artificial Sequence
  YS53 Fab heavy chain
EVQLVESGGGLVQPGGSLRLSCAASGFYISSSSIHWVRQAPGKGLEWVASISPYSGYTYYADSVKGRFTISADTSKNTAYLQMNSLRAEDTAVYYCSRSYYSSSYSSYYSSAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 702 - protein, 17 aa, Artificial Sequence
  YS54 CDRH2
SISPSSGSTYYADSVKG

SEQ ID NO: 703 - protein, 233 aa, Artificial Sequence
  YS54 Fab heavy chain
EVQLVESGGGLVQPGGSLRLSCAASGFSISSSSIHWVRQAPGKGLEWVASISPSSGSTYYADSVKGRFTISADTSKNTAYLQMNSLRAEDTAVYYCSRSYYSSSYSSYYSSAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 704 - protein, 13 aa, Artificial Sequence
  YS55 CDRH3
SYYSSSYYSYYSS

SEQ ID NO: 705 - protein, 233 aa, Artificial Sequence
  YS55 Fab heavy chain
EVQLVESGGGLVQPGGSLRLSCAASGFSISSSSIHWVRQAPGKGLEWVASISPSSGSTYYADSVKGRFTISADTSKNTAYLQMNSLRAEDTAVYYCSRSYYSSSYYSYYSSAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 706 - protein, 233 aa, Artificial Sequence
  YS56 Fab heavy chain
EVQLVESGGGLVQPGGSLRLSCAASGFSISSSSIHWVRQAPGKGLEWVASISPYSGYTYYADSVKGRFTISADTSKNTAYLQMNSLRAEDTAVYYCSRSYYSSSYYSYYSSAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 707 - protein, 17 aa, Artificial Sequence
  YS57 CDRH2
SISPYSGSTYYADSVKG

SEQ ID NO: 708 - protein, 233 aa, Artificial Sequence
  YS57 Fab heavy chain
EVQLVESGGGLVQPGGSLRLSCAASGFYISSSSIHWVRQAPGKGLEWVASISPYSGSTYYADSVKGRFTISADTSKNTAYLQMNSLRAEDTAVYYCSRSYYSSSYYSYYSSAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 709 - protein, 13 aa, Artificial Sequence
  YS58 CDRH3
SYYSSSYYYYYSS

SEQ ID NO: 710 - protein, 233 aa, Artificial Sequence
  YS58 Fab heavy chain
EVQLVESGGGLVQPGGSLRLSCAASGFSISSSSIHWVRQAPGKGLEWVASISPYSGSTYYADSVKGRFTISADTSKNTAYLQMNSLRAEDTAVYYCSRSYYSSSYYYYYSSAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 711 - protein, 17 aa, Artificial Sequence
  YS59 CDRH2
SISPSYGYTSYADSVKG

SEQ ID NO: 712 - protein, 13 aa, Artificial Sequence
  YS59 CDRH3
SYYSSSYSSYYSS

SEQ ID NO: 713 - protein, 233 aa, Artificial Sequence
  YS59 Fab heavy chain
EVQLVESGGGLVQPGGSLRLSCAASGFSISSSSIHWVRQAPGKGLEWVASISPSYGYTSYADSVKGRFTISADTSKNTAYLQMNSLRAEDTAVYYCSRSYYSSSYSSYYSSAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 714 - protein, 233 aa, Artificial Sequence
  YS60 Fab heavy chain
EVQLVESGGGLVQPGGSLRLSCAASGFSISSSSIHWVRQAPGKGLEWVASISPYSGSTYYADSVKGRFTISADTSKNTAYLQMNSLRAEDTAVYYCSRSYYSSSYSSYYSSAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 715 - protein, 9 aa, Artificial Sequence
  YS61 CDRH1
GFSISSYSI

SEQ ID NO: 716 - protein, 17 aa, Artificial Sequence
  YS61 CDRH2
SISPYSGSTYYADSVKG

SEQ ID NO: 717 - protein, 233 aa, Artificial Sequence
  YS61 Fab heavy chain
EVQLVESGGGLVQPGGSLRLSCAASGFSISSYSIHWVRQAPGKGLEWVASISPYSGSTYYADSVKGRFTISADTSKNTAYLQMNSLRAEDTAVYYCSRSYYYSSYSSYYSSAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 718 - protein, 17 aa, Artificial Sequence
  YS62 CDRH2
SISPSSGYTYYADSVKG

SEQ ID NO: 719 - protein, 13 aa, Artificial Sequence
  YS62 CDRH3
SYYSSSYSSYYSS

SEQ ID NO: 720 - protein, 233 aa, Artificial Sequence
  YS62 Fab heavy chain
EVQLVESGGGLVQPGGSLRLSCAASGFSISYSSIHWVRQAPGKGLEWVASISPSSGYTYYADSVKGRFTISADTSKNTAYLQMNSLRAEDTAVYYCSRSYYSSSYSSYYSSAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 721 - protein, 13 aa, Artificial Sequence
  YS63 CDRH3
SSYSSSYYSYYSS

SEQ ID NO: 722 - protein, 233 aa, Artificial Sequence
  YS63 Fab heavy chain.
EVQLVESGGGLVQPGGSLRLSCAASGFSISSSSIHWVRQAPGKGLEWVASISPYSGYTYYADSVKGRFTISADTSKNTAYLQMNSLRAEDTAVYYCSRSSYSSSYYSYYSSAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 723 - protein, 17 aa, Artificial Sequence
  NNK1 CDRH2
SIAPYAGATAYADSVKG

SEQ ID NO: 724 - protein, 11 aa, Artificial Sequence
  NNK1 CDRH3
ESLAHWSAMDY

SEQ ID NO: 725 - protein, 250 aa, Artificial Sequence
  YADS2  heavy chain variant
MKKNIAFLLASMFVFSIATNAYAEVQLVESGGGLVQPGGSLRLSCAASGFAIYDYDIHWVRQAPGKGLEWVASIAPYAGATAYADSVKGRFTISADTSKNTAYLQMNSLRAEDTAVYYCSRESLAHWSAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 726 - protein, 17 aa, Artificial Sequence
  NNK2 CDRH2
LIAPYAGATAYADSVKG

SEQ ID NO: 727 - protein, 11 aa, Artificial Sequence
  NNK2 CDRH3
SSFAFWLAMDY

SEQ ID NO: 728 - protein, 250 aa, Artificial Sequence
  YADS2 heavy chain variant
MKKNIAFLLASMFVFSIATNAYAEVQLVESGGGLVQPGGSLRLSCAASGFAIYDYDIHWVRQAPGKGLEWVALIAPYAGATAYADSVKGRFTISADTSKNTAYLQMNSLRAEDTAVYYCSRSSFAFWLAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 729 - protein, 17 aa, Artificial Sequence
  NNK3 CDRH2
MIAPYAGATAYADSVKG

SEQ ID NO: 730 - protein, 11 aa, Artificial Sequence
  NNK3 CDRH3
TSFAFWNAMDY

SEQ ID NO: 731 - protein, 250 aa, Artificial Sequence
  YADS2 heavy chain variant
MKKNIAFLLASMFVFSIATNAYAEVQLVESGGGLVQPGGSLRLSCAASGFAIYDYDIHWVRQAPGKGLEWVAMIAPYAGATAYADSVKGRFTISADTSKNTAYLQMNSLRAEDTAVYYCSRTSFAFWNAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 732 - protein, 17 aa, Artificial Sequence
  NNK4 CDRH2
RIAPYAGATAYADSVKG

SEQ ID NO: 733 - protein, 11 aa, Artificial Sequence
  NNK4 CDRH3
SSFAFFSAMDY

SEQ ID NO: 734 - protein, 250 aa, Artificial Sequence
  YADS2 heavy chain variant
MKKNIAFLLASMFVFSIATNAYAEVQLVESGGGLVQPGGSLRLSCAASGFAIYDYDIHWVRQAPGKGLEWVARIAPYAGATAYADSVKGRFTISADTSKNTAYLQMNSLRAEDTAVYYCSRSSFAFFSAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 735 - protein, 17 aa, Artificial Sequence
  NNK5 CDRH2
SIAPYAGATAYADSVKG

SEQ ID NO: 736 - protein, 11 aa, Artificial Sequence
  NNK5 CDRH3
ASFAFFSAMDY

SEQ ID NO: 737 - protein, 250 aa, Artificial Sequence
  YADS2 heavy chain variant
MKKNIAFLLASMFVFSIATNAYAEVQLVESGGGLVQPGGSLRLSCAASGFAIYDYDIHWVRQAPGKGLEWVASIAPYAGATAYADSVKGRFTISADTSKNTAYLQMNSLRAEDTAVYYCSRASFAFFSAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 738 - protein, 11 aa, Artificial Sequence
  NNK6 CDRH2
  MISC_FEATURE (1)..(1): Xaa is any naturally occurring amino acid or a stop codon
XSLALYDAMDY

SEQ ID NO: 739 - protein, 250 aa, Artificial Sequence
  YADS2 Heavy Chain Variant
  MISC_FEATURE (122)..(122): Xaa is any naturally occurring amino acid or a stop codon
MKKNIAFLLASMFVFSIATNAYAEVQLVESGGGLVQPGGSLRLSCAASGFAIYDYDIHWVRQAPGKGLEWVADIAPYAGATAYADSVKGRFTISADTSKNTAYLQMNSLRAEDTAVYYCSRXSLALYDAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 740 - protein, 17 aa, Artificial Sequence
  NNK7 CDRH2
YIAPYAGATAYADSVKG

SEQ ID NO: 741 - protein, 11 aa, Artificial Sequence
  NNK7 CDRH3
FSFAFRMAMDY

SEQ ID NO: 742 - protein, 250 aa, Artificial Sequence
  YADS2 heavy chain variant
MKKNIAFLLASMFVFSIATNAYAEVQLVESGGGLVQPGGSLRLSCAASGFAIYDYDIHWVRQAPGKGLEWVAYIAPYAGATAYADSVKGRFTISADTSKNTAYLQMNSLRAEDTAVYYCSRFSFAFRMAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 743 - protein, 17 aa, Artificial Sequence
  NNK8 CDRH2
GIAPYAGATAYADSVKG

SEQ ID NO: 744 - protein, 11 aa, Artificial Sequence
  NNK8 CDRH3
GSFAFFGAMDY

SEQ ID NO: 745 - protein, 250 aa, Artificial Sequence
  YADS2 heavy chain variant
MKKNIAFLLASMFVFSIATNAYAEVQLVESGGGLVQPGGSLRLSCAASGFAIYDYDIHWVRQAPGKGLEWVAGIAPYAGATAYADSVKGRFTISADTSKNTAYLQMNSLRAEDTAVYYCSRGSFAFFGAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 746 - protein, 17 aa, Artificial Sequence
  NNK9 CDRH2
LIAPYADATAYADSVKG

SEQ ID NO: 747 - protein, 11 aa, Artificial Sequence
  NNK9 CDRH3
SSYARWSAMDY

SEQ ID NO: 748 - protein, 249 aa, Artificial Sequence
  YADS2 heavy chain variant
MKKNIAFLLASMFVFSIATNAYAEVQLVESGGGLVQPGGSLRLSCAASGFAIYDYDIHWVRQAPGKGLEWALIAPYADATAYADSVKGRFTISADTSKNTAYLQMNSLRAEDTAVYYCSRSSYARWSAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 749 - protein, 17 aa, Artificial Sequence
  NNK10 CDRH2
YIAPYAGATAYADSVKG

SEQ ID NO: 750 - protein, 11 aa, Artificial Sequence
  NNK10 CDRH3
SSYAFFRAMDY

SEQ ID NO: 751 - protein, 250 aa, Artificial Sequence
  YADS2 heavy chain variant
MKKNIAFLLASMFVFSIATNAYAEVQLVESGGGLVQPGGSLRLSCAASGFAIYDYDIHWVRQAPGKGLEWVAYIAPYAGATAYADSVKGRFTISADTSKNTAYLQMNSLRAEDTAVYYCSRSSYAFFRAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 752 - protein, 17 aa, Artificial Sequence
  NNK11 CDRH2
IIAPYAGATAYADSVKG

SEQ ID NO: 753 - protein, 11 aa, Artificial Sequence
  NNK11 CDRH3
SSYAFFRAMDY

SEQ ID NO: 754 - protein, 250 aa, Artificial Sequence
  YADS2 heavy chain variant
MKKNIAFLLASMFVFSIATNAYAEVQLVESGGGLVQPGGSLRLSCAASGFAIYDYDIHWVRQAPGKGLEWVHIIAPYAGATAYADSVKGRFTISADTSKNTAYLQMNSLRAEDTAVYYCSASSYAFFRAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 755 - protein, 17 aa, Artificial Sequence
  NNK12 CDRH2
VIAPYAGATAYADSVKG

SEQ ID NO: 756 - protein, 11 aa, Artificial Sequence
  NNK12 CDRH3
NSFAFFGAMDY

SEQ ID NO: 757 - protein, 250 aa, Artificial Sequence
  YADS2 heavy chain variant
MKKNIAFLLASMFVFSIATNAYAEVQLVESGGGLVQPGGSLRLSCAASGFAIYDYDIHWVRQAPGKGLEWVAVIAPYAGATAYADSVKGRFTISADTSKNTAYLQMNSLRAEDTAVYYCSRNSFAFFGAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 758 - protein, 17 aa, Artificial Sequence
  NNK13 CDRH2
FIAPYAGATAYADSVKG

SEQ ID NO: 759 - protein, 11 aa, Artificial Sequence
  NNK13 CDRH3
SSFAFWMAMDY

SEQ ID NO: 760 - protein, 250 aa, Artificial Sequence
  YADS2 heavy chain variant
MKKNIAFLLASMFVFSIATNAYAEVQLVESGGGLVQPGGSLRLSCAASGFAIYDYDIHWVRQAPGKGLEWVAFIAPYAGATAYADSVKGRFTISADTSKNTAYLQMNSLRAEDTAVYYCSRSSFAFWMAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 761 - protein, 11 aa, Artificial Sequence
  NNK14 CDRH3
GSFAFWSAMDY

SEQ ID NO: 762 - protein, 250 aa, Artificial Sequence
  YADS2 heavy chain variant
MKKNIAFLLASMFVFSIATNAYAEVQLVESGGGLVQPGGSLRLSCAASGFAIYDYDIHWVRQAPGKGLEWVAFIAPYAGATAYADSVKGRFTISADTSKNTAYLQMNSLRAEDTAVYYCSRGSFAFWSAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 763 - protein, 11 aa, Artificial Sequence
  NNK15 CDRH3
NSFAFFGAMDY

SEQ ID NO: 764 - protein, 250 aa, Artificial Sequence; identical to SEQ ID NO: 757
  YADS2 heavy chain variant

SEQ ID NO: 765 - protein, 17 aa, Artificial Sequence
  NNK16 CDRH2
NIAPYAGATAYADSVKG

SEQ ID NO: 766 - protein, 11 aa, Artificial Sequence
  NNK16 CDRH3
SSFAFFMAMDY

SEQ ID NO: 767 - protein, 250 aa, Artificial Sequence
  YADS2 heavy chain variant
MKKNIAFLLASMFVFSIATNAYAEVQLVESGGGLVQPGGSLRLSCAASGFAIYDYDIHWVRQAPGKGLEWVANIAPYAGATAYADSVKGRFTISADTSKNTAYLQMNSLRAEDTAVYYCSRSSFAFFMAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 768 - protein, 17 aa, Artificial Sequence
  NNK17 CDRH2
VIAPYAGATAYADSVKG

SEQ ID NO: 769 - protein, 250 aa, Artificial Sequence; identical to SEQ ID NO: 757
  YADS2 heavy chain variant

SEQ ID NO: 770 - protein, 17 aa, Artificial Sequence
  NNK18 CDRH2
FIAPYAGATAYADSVKG

SEQ ID NO: 771 - protein, 11 aa, Artificial Sequence
  NNK18 CDRH3
RSFAFYNAMDY

SEQ ID NO: 772 - protein, 250 aa, Artificial Sequence
  YADS2 heavy chain variant
MKKNIAFLLASMFVFSIATNAYAEVQLVESGGGLVQPGGSLRLSCAASGFAIYDYDIHWVRQAPGKGLEWVAFIAPYAGATAYADSVKGRFTISADTSKNTAYLQMNSLRAEDTAVYYCSRRSFAFYNAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 773 - protein, 11 aa, Artificial Sequence
  NNK19 CDRH3
SSFAFYGAMDY

SEQ ID NO: 774 - protein, 250 aa, Artificial Sequence
  YADS2 heavy chain variant
MKKNIAFLLASMFVFSIATNAYAEVQLVESGGGLVQPGGSLRLSCAASGFAIYDYDIHWVRQAPGKGLEWVAFIAPYAGATAYADSVKGRFTISADTSKNTAYLQMNSLRAEDTAVYYCSRSSFAFYGAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 775 - protein, 11 aa, Artificial Sequence
  NNK20 CDRH3
SSFAFKAAMDY

SEQ ID NO: 776 - protein, 250 aa, Artificial Sequence
  YADS2 heavy chain variant
MKKNIAFLLASMFVFSIATNAYAEVQLVESGGGLVQPGGSLRLSCAASGFAIYDYDIHWVRQAPGKGLEWVAFIAPYAGATAYADSVKGRFTISADTSKNTAYLQMNSLRAEDTAVYYCSRSSFAFKAAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 777 - protein, 17 aa, Artificial Sequence
  NNK21 CDRH2
AIAPYAGATAYADSVKG

SEQ ID NO: 778 - protein, 11 aa, Artificial Sequence
  NNK21 CDRH3
LSFALYNAMDY

SEQ ID NO: 779 - protein, 250 aa, Artificial Sequence
  YADS2 heavy chain variant
MKKNIAFLLASMFVFSIATNAYAEVQLVESGGGLVQPGGSLRLSCAASGFAIYDYDIHWVRQAPGKGLEWVAAIAPYAGATAYADSVKGRFTISADTSKNTAYLQMNSLRAEDTAVYYCSRLSFALYNAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 780 - protein, 17 aa, Artificial Sequence
  NNK22 CDRH2
YIAPYAGATAYADSVKG

SEQ ID NO: 781 - protein, 11 aa, Artificial Sequence
  NNK22 CDRH3
VSWAFFQAMDY

SEQ ID NO: 782 - protein, 250 aa, Artificial Sequence
  YADS2 heavy chain variant
MKKNIAFLLASMFVFSIATNAYAEVQLVESGGGLVQPGGSLRLSCAASGFAIYDYDIHWVRQAPGKGLEWVAYIAPYAGATAYADSVKGRFTISADTSKNTAYLQMNSLRAEDTAVYYCSRVSWAFFQAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 783 - protein, 17 aa, Artificial Sequence
  NNK23 CDRH2
WIAPYAGATAYADSVKG

SEQ ID NO: 784 - protein, 11 aa, Artificial Sequence
  NNK23 CDRH3
LSLAYFHAMDY

SEQ ID NO: 785 - protein, 250 aa, Artificial Sequence
  YADS2 heavy chain variant
MKKNIAFLLASMFVFSIATNAYAEVQLVESGGGLVQPGGSLRLSCAASGFAIYDYDIHWVRQAPGKGLEWVAWIAPYAGATAYADSVKGRFTISADTSKNTAYLQMNSLRAEDTAVYYCSRLSLAYFHAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 786 - protein, 17 aa, Artificial Sequence
  NNK24 CDRH2
VIAPYAGATAYADSVKG

SEQ ID NO: 787 - protein, 11 aa, Artificial Sequence
  NNK24 CDRH3
NSFAFFGAMDY

SEQ ID NO: 788 - protein, 250 aa, Artificial Sequence; identical to SEQ ID NO: 757
  YADS2 heavy chain variant

SEQ ID NO: 789 - protein, 11 aa, Artificial Sequence
  NNK25 CDRH3
ISFAFFGAMDY

SEQ ID NO: 790 - protein, 250 aa, Artificial Sequence
  YADS2 heavy chain variant
MKKNIAFLLASMFVFSIATNAYAEVQLVESGGGLVQPGGSLRLSCAASGFAIYDYDIHWVRQAPGKGLEWVAVIAPYAGATAYADSVKGRFTISADTSKNTAYLQMNSLRAEDTAVYYCSRISFAFFGAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 791 - protein, 11 aa, Artificial Sequence
  NNK26 CDRH3
SSFAHMHAMDY

SEQ ID NO: 792 - protein, 250 aa, Artificial Sequence
  YADS2 heavy chain variant
MKKNIAFLLASMFVFSIATNAYAEVQLVESGGGLVQPGGSLRLSCAASGFAIYDYDIHWVRQAPGKGLEWVASIAPYAGATAYADSVKGRFTISADTSKNTAYLQMNSLRAEDTAVYYCSRSSFAHMHAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 793 - protein, 17 aa, Artificial Sequence
  NNK27 CDRH2
VIAPYAGATAYADSVKG

SEQ ID NO: 794 - protein, 250 aa, Artificial Sequence
  YADS2 heavy chain variant
MKKNIAFLLASMFVFSIATNAYAEVQLVESGGGLVQPGGSLRLSCAASGFAIYDYDIHWVRQAPGKGLEWVAVIAPYAGATAYADSVKGRFTISADTSKNTAYLQMNSLRAEDTAVYYCSRNSFAFFGDMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 795 - protein, 10 aa, Artificial Sequence
  YS #1 CDR-H1
GFYISSSSIH

SEQ ID NO: 796 - protein, 17 aa, Artificial Sequence
  YS #1 CDR-H2
SISPSSGSTIYADSVKG

SEQ ID NO: 797 - protein, 15 aa, Artificial Sequence
  YS #1 CDR-H3
YYSSSSSYSYSAMDY

SEQ ID NO: 798 - protein, 231 aa, Artificial Sequence
  YS #1 HC
EVQLVESGGGLVQPGGSLRLSCAASGFYISSSSIHWVRQAPGKGLEWVASISPSSGSTIYADSVKGRFTISADTSKNTAYLQMNSLRAEDTAVYYCSRYYSSSSSYSYSAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 799 - protein, 5 aa, Artificial Sequence
  YS #2 CDR-H1
GFIIH

SEQ ID NO: 800 - protein, 17 aa, Artificial Sequence
  YS #2 CDR-H2
YIYPSYGSTSYADSVKG

SEQ ID NO: 801 - protein, 17 aa, Artificial Sequence
  YS #2 CDR-H3
YYYSSYSSSYYSSAMDY

SEQ ID NO: 802 - protein, 228 aa, Artificial Sequence
  YS #2 HC
EVQLVESGGGLVQPGGSLRLSCAASGFIIHWVRQAPGKGLEWVAYIYPSYGSTSYADSVKGRFTISADTSKNTAYLQMNSLRAEDTAVYYCSRYYYSSYSSSYYSSAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 803 - protein, 10 aa, Artificial Sequence
  YS #3 CDR-H1
GFYISSSSIH

SEQ ID NO: 804 - protein, 17 aa, Artificial Sequence
  YS #3 CDR-H2
SISPYSGYTYYADSVKG

SEQ ID NO: 805 - protein, 17 aa, Artificial Sequence
  YS #3 CDR-H3
SYYSSSYSSYYSSAMDY

SEQ ID NO: 806 - protein, 233 aa, Artificial Sequence; identical to SEQ ID NO: 701
  YS #3 HC

SEQ ID NO: 807 - protein, 10 aa, Artificial Sequence
  YS #4 CDR-H1
GFSISSSSIH

SEQ ID NO: 808 - protein, 17 aa, Artificial Sequence
  YS #4 CDR-H2
SISPSSGSTYYADSVKG

SEQ ID NO: 809 - protein, 17 aa, Artificial Sequence
  YS #4 CDR-H3
SYYSSSYSSYYSSAMDY

SEQ ID NO: 810 - protein, 233 aa, Artificial Sequence; identical to SEQ ID NO: 703
  YS #4 HC

SEQ ID NO: 811 - protein, 5 aa, Artificial Sequence
  YS #5 CDR-H1
GFIIH

SEQ ID NO: 812 - protein, 17 aa, Artificial Sequence
  YS #5 CDR-H2
SISPSSGSTYYADSVKG

SEQ ID NO: 813 - protein, 17 aa, Artificial Sequence
  YS #5 CDR-H3
SYYSSSYYSYYSSAMDY

SEQ ID NO: 814 - protein, 228 aa, Artificial Sequence
  YS #5 HC
EVQLVESGGGLVQPGGSLRLSCAASGFIIHWVRQAPGKGLEWVASISPSSGSTYYADSVKGRFTISADTSKNTAYLQMNSLRAEDTAVYYCSRSYYSSSYYSYYSSAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 815 - protein, 10 aa, Artificial Sequence
  YS #6 CDR-H1
GFSISSSSIH

SEQ ID NO: 816 - protein, 17 aa, Artificial Sequence
  YS #6 CDR-H2
SISPYSGYTYYADSVKG

SEQ ID NO: 817 - protein, 17 aa, Artificial Sequence
  YS #6 CDR-H3
SYYSSSYYSYYSSAMDY

SEQ ID NO: 818 - protein, 233 aa, Artificial Sequence; identical to SEQ ID NO: 706
  YS #6 HC

SEQ ID NO: 819 - protein, 10 aa, Artificial Sequence
  YS #7 CDR-H1
GFYISSSSIH

SEQ ID NO: 820 - protein, 17 aa, Artificial Sequence
  YS #7 CDR-H2
SISPYSGSTYYADSVKG

SEQ ID NO: 821 - protein, 17 aa, Artificial Sequence
  YS #7 CDR-H3
SYYSSSYYSYYSSAMDY

SEQ ID NO: 822 - protein, 233 aa, Artificial Sequence; identical to SEQ ID NO: 708
  YS #7 HC

SEQ ID NO: 823 - protein, 10 aa, Artificial Sequence
  YS #8 CDR-H1
GFSISSSSIH

SEQ ID NO: 824 - protein, 17 aa, Artificial Sequence
  YS #8 CDR-H2
SISPYSGSTYYADSVKG

SEQ ID NO: 825 - protein, 17 aa, Artificial Sequence
  YS #8 CDR-H3
SYYSSSYYYYYSSAMDY

SEQ ID NO: 826 - protein, 233 aa, Artificial Sequence; identical to SEQ ID NO: 710
  YS #8 HC

SEQ ID NO: 827 - protein, 10 aa, Artificial Sequence
  YS #9 CDR-H1
GFSISSSSIH

SEQ ID NO: 828 - protein, 17 aa, Artificial Sequence
  YS #9 CDR-H2
SISPSYGYTSYADSVKG

SEQ ID NO: 829 - protein, 17 aa, Artificial Sequence
  YS #9 CDR-H3
SYYSSSYSSYYSSAMDY

SEQ ID NO: 830 - protein, 233 aa, Artificial Sequence; identical to SEQ ID NO: 713
  YS #9 HC

SEQ ID NO: 831 - protein, 10 aa, Artificial Sequence
  YS #10 CDR-H1
GFSISSSSIH

SEQ ID NO: 832 - protein, 17 aa, Artificial Sequence
  YS #10 CDR-H2
SISPYSGSTYYADSVKG

SEQ ID NO: 833 - protein, 17 aa, Artificial Sequence
  YS #10 CDR-H3
SYYSSSYSSYYSSAMDY

SEQ ID NO: 834 - protein, 233 aa, Artificial Sequence; identical to SEQ ID NO: 714
  YS #10 HC

SEQ ID NO: 835 - protein, 10 aa, Artificial Sequence
  YS #11 CDR-H1
GFSISSYSIH

SEQ ID NO: 836 - protein, 17 aa, Artificial Sequence
  YS #11 CDR-H2
SISPYSGSTYYADSVKG

SEQ ID NO: 837 - protein, 17 aa, Artificial Sequence
  YS #11 CDR-H3
SSYSSSYSSYYSSAMDY

SEQ ID NO: 838 - protein, 233 aa, Artificial Sequence
  YS #11 HC
EVQLVESGGGLVQPGGSLRLSCAASGFSISSSSIHWVRQAPGKGLEWVASISPYSGSTYYADSVKGRFTISADTSKNTAYLQMNSLRAEDTAVYYCSRSSYSSSYSSYYSSAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 839 - protein, 5 aa, Artificial Sequence
  YS #12 CDR-H1
GFIIH

SEQ ID NO: 840 - protein, 17 aa, Artificial Sequence
  YS #12 CDR-H2
SISPSSGSTSYADSVKG

SEQ ID NO: 841 - protein, 17 aa, Artificial Sequence
  YS #12 CDR-H3
SYSYSSYSYSYSYAMDY

SEQ ID NO: 842 - protein, 228 aa, Artificial Sequence
  YS #12 HC
EVQLVESGGGLVQPGGSLRLSCAASGFIIHWVRQAPGKGLEWVASISPSSGSTSYADSVKGRFTISADTSKNTAYLQMNSLRAEDTAVYYCSRSYSYSSYSYSYSYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 843 - protein, 10 aa, Artificial Sequence
  YS #13 CDR-H1
GFSISSSSIH

SEQ ID NO: 844 - protein, 17 aa, Artificial Sequence
  YS #13 CDR-H2
YISPYSGSTSYADSVKG

SEQ ID NO: 845 - protein, 19 aa, Artificial Sequence
  YS #13 CDR-H3
YYYSYYSSSYSSYYYAMDY

SEQ ID NO: 846 - protein, 235 aa, Artificial Sequence
  YS #13 HC
EVQLVESGGGLVQPGGSLRLSCAASGFSISSSSIHWVRQAPGKGLEWVAYISPYSGSTSYADSVKGRFTISADTSKNTAYLQMNSLRAEDTAVYYCSRYYYSYYSSSYSSYYYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 847 - protein, 10 aa, Artificial Sequence
  YS #14 CDR-H1
GFSIYSSSIH

SEQ ID NO: 848 - protein, 17 aa, Artificial Sequence
  YS #14 CDR-H2
YISPYSGSTSYADSVKG

SEQ ID NO: 849 - protein, 16 aa, Artificial Sequence
  YS #14 CDR-H3
YYSSSYSYSYYYAMDY

SEQ ID NO: 850 - protein, 232 aa, Artificial Sequence; identical to SEQ ID NO: 670
  YS #14 HC

SEQ ID NO: 851 - protein, 10 aa, Artificial Sequence
  YS #15 CDR-H1
GFSISYSSIH

SEQ ID NO: 852 - protein, 17 aa, Artificial Sequence
  YS #15 CDR-H2
YISPYSGSTSYADSVKG

SEQ ID NO: 853 - protein, 19 aa, Artificial Sequence
  YS #15 CDR-H3
YSSYSSSSYYSSYYYAMDY

SEQ ID NO: 854 - protein, 235 aa, Artificial Sequence
  YS #15 HC
EVQLVESGGGLVQPGGSLRLSCAASGFSISYSSIHWVRQAPGKGLEWVAYISPYSGSTSYADSVKGRFTISADTSKNTAYLQMNSLRAEDTAVYYCSRYSSYSSSSYYSSYYYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 855 - protein, 10 aa, Artificial Sequence
  YS #16 CDR-H1
GFSIYYSSIH

SEQ ID NO: 856 - protein, 17 aa, Artificial Sequence
  YS #16 CDR-H2
YISPSSGSTSYADSVKG

SEQ ID NO: 857 - protein, 16 aa, Artificial Sequence
  YS #16 CDR-H3
YYSSSSYYSYYYAMDY

SEQ ID NO: 858 - protein, 232 aa, Artificial Sequence
  YS #16 HC
EVQLVESGGGLVQPGGSLRLSCAASGFSIYYSSIHWVRQAPGKGLEWVAYISPSSGSTSYADSVKGRFTISADTSKNTAYLQMNSLRAEDTAVYYCSRYYSSSSYYSYYYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 859 - protein, 10 aa, Artificial Sequence
  YS #17 CDR-H1
GFSISSSSIH

SEQ ID NO: 860 - protein, 17 aa, Artificial Sequence
  YS #17 CDR-H2
YISPSSGSTSYADSVKG

SEQ ID NO: 861 - protein, 16 aa, Artificial Sequence
  YS #17 CDR-H3
YYSSSYYYSYYYAMDY

SEQ ID NO: 862 - protein, 232 aa, Artificial Sequence; identical to SEQ ID NO: 43
  YS #17 HC

SEQ ID NO: 863 - protein, 10 aa, Artificial Sequence
  YS #18 CDR-H1
GFSIYSSSIH

SEQ ID NO: 864 - protein, 17 aa, Artificial Sequence
  YS #18 CDR-H2
YISPSSGSTSYADSVKG

SEQ ID NO: 865 - protein, 16 aa, Artificial Sequence
  YS #18 CDR-H3
YYYSYSSYSYYYAMDY

SEQ ID NO: 866 - protein, 232 aa, Artificial Sequence; identical to SEQ ID NO: 672
  YS #18 HC

SEQ ID NO: 867 - protein, 10 aa, Artificial Sequence
  YS #19 CDR-H1
GFSISYSSIH

SEQ ID NO: 868 - protein, 17 aa, Artificial Sequence
  YS #19 CDR-H2
YISPYSGSTSYADSVKG

SEQ ID NO: 869 - protein, 18 aa, Artificial Sequence
  YS #19 CDR-H3
YYSSYSYYSSSYYYAMDY

SEQ ID NO: 870 - protein, 234 aa, Artificial Sequence; identical to SEQ ID NO: 594
  YS #19 HC

SEQ ID NO: 871 - protein, 10 aa, Artificial Sequence
  YS #20 CDR-H1
GFSISYSSIH

SEQ ID NO: 872 - protein, 17 aa, Artificial Sequence
  YS #20 CDR-H2
YISPSSGSTSYADSVKG

SEQ ID NO: 873 - protein, 16 aa, Artificial Sequence
  YS #20 CDR-H3
YYSSSSYYSYYYAMDY

SEQ ID NO: 874 - protein, 232 aa, Artificial Sequence
  YS #20 HC
EVQLVESGGGLVQPGGSLRLSCAASGFSIYSSSIHWVRQAPGKGLEWVAYISPSSGSTSYADSVKGRFTISADTSKNTAYLQMNSLRAEDTAVYYCSRYYSSSSYYSYYYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 875 - protein, 10 aa, Artificial Sequence
  YS #21 CDR-H1
GFSIYSSSIH

SEQ ID NO: 876 - protein, 17 aa, Artificial Sequence
  YS #21 CDR-H2
SISPYSGSTSYADSVKG

SEQ ID NO: 877 - protein, 11 aa, Artificial Sequence
  YS #21 CDR-H3
STYAFFSAMDY

SEQ ID NO: 878 - protein, 227 aa, Artificial Sequence
  YS #21 HC
EVQLVESGGGLVQPGGSLRLSCAASGFSIYSSSIHWVRQAPGKGLEWVASISPYSGSTSYADSVKGRFTISADTSKNTAYLQMNSLRAEDTAVYYCSRSTYAFFSAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 879 - protein, 10 aa, Artificial Sequence
  YS #22 CDR-H1
GFSIYSYSIH

SEQ ID NO: 880 - protein, 17 aa, Artificial Sequence
  YS #22 CDR-H2
SISPYSGSTSYADSVKG

SEQ ID NO: 881 - protein, 11 aa, Artificial Sequence
  YS #22 CDR-H3
SSYAFFSAMDY

SEQ ID NO: 882 - protein, 227 aa, Artificial Sequence
  YS #22 HC
EVQLVESGGGLVQPGGSLRLSCAASGFSIYSYSIHWVRQAPGKGLEWVASISPYSGSTSYADSVKGRFTISADTSKNTAYLQMNSLRAEDTAVYYCSRSSYAFFSAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 883 - protein, 10 aa, Artificial Sequence
  YS #23 CDR-H1
GFSISSYSIH

SEQ ID NO: 884 - protein, 17 aa, Artificial Sequence
  YS #23 CDR-H2
YISPYSGSTSYADSVKG

SEQ ID NO: 885 - protein, 11 aa, Artificial Sequence
  YS #23 CDR-H3
SSYAFFGAMDY

SEQ ID NO: 886 - protein, 227 aa, Artificial Sequence
  YS #23 HC
EVQLVESGGGLVQPGGSLRLSCAASGFSISSYSIHWVRQAPGKGLEWVAYISPYSGSTSYADSVKGRFTISADTSKNTAYLQMNSLRAEDTAVYYCSRSSYAFFGAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 887 - protein, 10 aa, Artificial Sequence
  YS #24 CDR-H1
GFYISSYSIH

SEQ ID NO: 888 - protein, 17 aa, Artificial Sequence
  YS #24 CDR-H2
SISPYSGSTSYADSVKG

SEQ ID NO: 889 - protein, 11 aa, Artificial Sequence
  YS #24 CDR-H3
TSYAFFGAMDY

SEQ ID NO: 890 - protein, 227 aa, Artificial Sequence
  YS #24 HC
EVQLVESGGGLVQPGGSLRLSCAASGFYISSYSIHWVRQAPGKGLEWVASISPYSGSTSYADSVKGRFTISADTSKNTAYLQMNSLRAEDTAVYYCSRTSYAFFGAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 891 - protein, 10 aa, Artificial Sequence
  YS #25 CDR-H1
GFSIYSYSIH

SEQ ID NO: 892 - protein, 17 aa, Artificial Sequence
  YS #25 CDR-H2
SISPYSGSTSYADSVKG

SEQ ID NO: 893 - protein, 11 aa, Artificial Sequence
  YS #25 CDR-H3
SSFAFFSAMDY

SEQ ID NO: 894 - protein, 227 aa, Artificial Sequence
  YS #25 HC
EVQLVESGGGLVQPGGSLRLSCAASGFSIYSYSIHWVRQAPGKGLEWVASISPYSGSTSYADSVKGRFTISADTSKNTAYLQMNSLRAEDTAVYYCSRSSFAFFSAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 895 - protein, 10 aa, Artificial Sequence
  YS #26 CDR-H1
GFSIYSYSIH

SEQ ID NO: 896 - protein, 17 aa, Artificial Sequence
  YS #26 CDR-H2
SISPSYGSTYYADSVKG

SEQ ID NO: 897 - protein, 11 aa, Artificial Sequence
  YS #26 CDR-H3
SSFAFFGAMDY

SEQ ID NO: 898 - protein, 227 aa, Artificial Sequence
  YS #26 HC
EVQLVESGGGLVQPGGSLRLSCAASGFSIYSYSIHWVRQAPGKGLEWVASISPSYGSTYYADSVKGRFTISADTSKNTAYLQMNSLRAEDTAVYYCSRSSFAFFGAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 899 - protein, 10 aa, Artificial Sequence
  YS #27 CDR-H1
GFSIYSSSIH

SEQ ID NO: 900 - protein, 17 aa, Artificial Sequence
  YS #27 CDR-H2
SISPYSGSTSYADSVKG

SEQ ID NO: 901 - protein, 11 aa, Artificial Sequence
  YS #27 CDR-H3
STFAFYSAMDY

SEQ ID NO: 902 - protein, 227 aa, Artificial Sequence
  YS #27 HC
EVQLVESGGGLVQPGGSLRLSCAASGFSIYSSSIHWVRQAPGKGLEWVASISPYSGSTSYADSVKGRFTISADTSKNTAYLQMNSLRAEDTAVYYCSRSTFAFYSAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 903 - protein, 10 aa, Artificial Sequence
  YS #28 CDR-H1
GFSISYSSIH

SEQ ID NO: 904 - protein, 17 aa, Artificial Sequence
  YS #28 CDR-H2
SISPYSGYTSYADSVKG

SEQ ID NO: 905 - protein, 23 aa, Artificial Sequence
  YS #28 CDR-H3
SSYYYSSSYYYYYSSYSSSAMDY

SEQ ID NO: 906 - protein, 239 aa, Artificial Sequence
  YS #28 HC
EVQLVESGGGLVQPGGSLRLSCAASGFSISYSSIHWVRQAPGKGLEWVASISPYSGYTSYADSVKGRFTISADTSKNTAYLQMNSLRAEDTAVYYCSRSSYYYSSSYYYYYSSYSSSAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 907 - protein, 10 aa, Artificial Sequence
  YS #29 CDR-H1
GFSISYSSIH

SEQ ID NO: 908 - protein, 17 aa, Artificial Sequence
  YS #29 CDR-H2
SISPYSGYTSYADSVKG

SEQ ID NO: 909 - protein, 23 aa, Artificial Sequence
  YS #29 CDR-H3
SSYYYPPSYYYYNSSYSSSAMDY

SEQ ID NO: 910 - protein, 239 aa, Artificial Sequence
  YS #29 HC
EVQLVESGGGLVQPGGSLRLSCAASGFSISYSSIHWVRQAPGKGLEWVASISPYSGYTSYADSVKGRFTISADTSKNTAYLQMNSLRAEDTAVYYCSRSSYYYPPSYYYYNSSYSSSAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 911 - protein, 10 aa, Artificial Sequence
  YS #30 CDR-H1
GFSIYYSSIH

SEQ ID NO: 912 - protein, 17 aa, Artificial Sequence
  YS #30 CDR-H2
SIYPYSGSTSYADSVKG

SEQ ID NO: 913 - protein, 24 aa, Artificial Sequence
  YS #30 CDR-H3
YYSYYSSYYYSSSSSSSYSSAMDY

SEQ ID NO: 914 - protein, 240 aa, Artificial Sequence
  YS #30 HC
EVQLVESGGGLVQPGGSLRLSCAASGFSIYYSSIHWVRQAPGKGLEWVASIYPYSGSTSYADSVKGRFTISADTSKNTAYLQMNSLRAEDTAVYYCSRYYSYYSSYYYSSSSSSSYSSAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 915 - protein, 7 aa, Artificial Sequence
  CDRH3
  MISC_FEATURE (1)..(1): Xaa is Tyr or Phe
  MISC_FEATURE (2)..(2): Xaa is Val or Ala
  MISC_FEATURE (4)..(4): Xaa is Phe or Tyr
  MISC_FEATURE (5)..(5): Xaa is Leu or Ala
  MISC_FEATURE (6)..(6): Xaa is Pro or Ala
  MISC_FEATURE (7)..(7): Xaa is Tyr or Phe
XXFXXXX

SEQ ID NO: 916 - protein, 6 aa, Artificial Sequence
  CDRL1
  MISC_FEATURE (1)..(2): Xaa is any amino acid
  MISC_FEATURE (3)..(4): Xaa is Arg
  MISC_FEATURE (5)..(5): Xaa is Ser or Ala
XXXXXL

SEQ ID NO: 917 - protein, 3 aa, Artificial Sequence
  CDRL2
  MISC_FEATURE (1)..(1): Xaa is Ser or Ala or Gly
  MISC_FEATURE (2)..(3): Xaa is any amino acid
XXX

SEQ ID NO: 918 - protein, 6 aa, Artificial Sequence
  CDRL3
  MISC_FEATURE (2)..(3): Xaa is any amino acid
  MISC_FEATURE (4)..(4): Xaa is Ser or Ala
SXXXPL

SEQ ID NO: 919 - protein, 6 aa, Artificial Sequence
  CDRL2
  MISC_FEATURE (1)..(1): Xaa is Ser, Ala or Gly
  MISC_FEATURE (4)..(4): Xaa is any amino acid
  MISC_FEATURE (6)..(6): Xaa is any amino acid
XASXLX

SEQ ID NO: 920 - DNA, 27 bp, Artificial Sequence
  Terminator Sequence
gctcggttgccgccgggcgttttttat

SEQ ID NO: 921 - protein, 6 aa, Artificial Sequence
  B29 CDRH1
TGSGIH

SEQ ID NO: 922 - protein, 18 aa, Artificial Sequence
  B29 CDRH2
GWIYPYSGNTYYADSVKG

SEQ ID NO: 923 - protein, 12 aa, Artificial Sequence
  B29 CDRH3
ALWAFVPAAMDY

SEQ ID NO: 924 - protein, 228 aa, Artificial Sequence
  B29 heavy chain
EVQLVESGGGLVQPGGSLRLSCAASGFTITGSGIHWVRQAPGKGLEWVGAIYPYSGYTNYADSVKGRFTISADTSKNTAYLQMNSLRAEDTAVYYCARALWAFVPAAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 925 - protein, 6 aa, Artificial Sequence
  C3 CDRH1
TGSSIH

SEQ ID NO: 926 - protein, 18 aa, Artificial Sequence
  C3 CDRH2
ARISPAGGYTDYADSVKG

SEQ ID NO: 927 - protein, 228 aa, Artificial Sequence
  C3 heavy chain
EVQLVESGGGLVQPGGSLRLSCAASGFTITGSSIHWVRQAPGKGLEWVARISPAGGYTDYADSVKGRFTISADTSKNTAYLQMNSLRAEDTAVYYCARYFRWYMPAAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 928 - protein, 12 aa, Artificial Sequence
  C3 CDRH3
YFRWYMPAAMDY

SEQ ID NO: 929 - protein, 7 aa, Artificial Sequence
  CDR-H3
FVFFLPY

SEQ ID NO: 930 - protein, 11 aa, Artificial Sequence
  CDR-H3
FVFFLPYAMDY

SEQ ID NO: 931 - protein, 8 aa, Artificial Sequence
  CDR-H3
WGHSTSPW

SEQ ID NO: 932 - protein, 12 aa, Artificial Sequence
  CDR-H3
WGHSTSPWAMDY

SEQ ID NO: 933 - protein, 7 aa, Artificial Sequence
  CDR-H3
ALWAFVA

SEQ ID NO: 934 - protein, 7 aa, Artificial Sequence
  CDR-H3
YFRWYMA

SEQ ID NO: 935 - protein, 11 aa, Artificial Sequence
  Peptide to increase half-life of Fab antibody
DICLPRWGCLW

SEQ ID NO: 936 - protein, 5 aa, Artificial Sequence
  CDR-H1
ASWIH

SEQ ID NO: 937 - protein, 11 aa, Artificial Sequence
  CDR-H2
GAIYPYSGYTN

SEQ ID NO: 938 - protein, 5 aa, Artificial Sequence
  CDR-H1
GSWIF

SEQ ID NO: 939 - protein, 11 aa, Artificial Sequence
  CDR-H2
GAIWPFGGYTH

SEQ ID NO: 940 - protein, 17 aa, Artificial Sequence
  CDR-H2
AIYPYSGYTNYADSVKG

SEQ ID NO: 941 - protein, 17 aa, Artificial Sequence
  CDR-H2
AIWPFGGYTHYADSVKG

What is claimed is:

1. An isolated antibody, or an Fab fragment thereof, capable of binding to mouse VEGF and human VEGF with Kd values within 10 fold of the other, wherein the antibody is capable of inhibiting the binding of VEGF to a VEGF receptor and wherein the antibody comprises a CDR-H1 comprising the amino acid sequence ASWIH (SEQ ID NO: 936), a CDR-H2 comprising the amino acid sequence AIYPYSGYT-NYADSVKG (SEQ ID NO: 940), a CDR-H3 comprising the amino acid sequence WGHSTSPWAMDY (SEQ ID NO: 932), a CDR-L1 comprising the amino acid sequence RASQDVSTAVA (SEQ ID NO: 85), a CDR-L2 comprising the amino acid sequence SASFLYS (SEQ ID NO: 86), and a CDR-L3 comprising the amino acid sequence QQSYTTPPT (SEQ ID NO: 87).

2. An isolated antibody, or an Fab fragment thereof, capable of binding to mouse VEGF and human VEGF with Kd values within 10 fold of the other, wherein the antibody is capable of inhibiting the binding of VEGF to a VEGF receptor and wherein the antibody comprises a CDR-H1 comprising the amino acid sequence ASWIH (SEQ ID NO: 936), a CDR-H2 comprising the amino acid sequence AIYPYSGYT-NYADSVKG (SEQ ID NO: 940), a CDR-H3 comprising the amino acid sequence WGHSTSPWAMDY (SEQ ID NO: 932), a CDR-L1 comprising the amino acid sequence RASQVIRRSLA (SEQ ID NO: 117), a CDR-L2 comprising the amino acid sequence AASNLAS (SEQ ID NO: 118), and a CDR-L3 comprising the amino acid sequence QQSNTSPLT (SEQ ID NO: 119).

3. An isolated antibody, or an Fab fragment thereof, capable of binding to mouse VEGF and human VEGF with Kd values within 10 fold of the other, wherein the antibody is capable of inhibiting the binding of VEGF to a VEGF receptor and wherein the antibody comprises a CDR-H1 comprising the amino acid sequence ASWIH (SEQ ID NO: 936), a CDR-H2 comprising the amino acid sequence AIYPYSGYT-NYADSVKG (SEQ ID NO: 940), a CDR-H3 comprising the amino acid sequence WGHSTSPWAMDY (SEQ ID NO: 932), and wherein the antibody further comprises one of the following amino acid sequence as its light chain variable domain (VL):

DIQMTQSPSSLSASVGDRVTITCRASQDVSTAVAWY QQKPGKAPKLLIYSASFLYSGVPSRFSGSGSGTD FTLTISSLQPEDFATYYCQQSYTTPPTFGQGTKV EIKRTVAAPSVFIFPPSDEQLKSGTASVVCLLNN FYPREAKVQWKVDNALQSGNSQESVTEQDSKD STYSLSSTLTLSKADYEKHKVYACEVTHQGLSSP VTKSFNRGEC (SEQ ID NO 37)

or

DIQMTQSPSSLSASVGDRVTITCRASQVIRRSLAWY QQKPGKAPKLLIYAASNLASGVPSRFSGSGSGT DFTLTISSLQPEDFATYYCQQSNTSPLTFGQGTKV EIKRTVAAPSVFIFPPSDEQLKSGTASVVCLLNNF YPREAKVQWKVDNALQSGNSQESVTEQDSKDS

TYSLSSTLTLSKADYEKHKVYACEVTHQGLSSP
VTKSFNRGEC (SEQ ID NO: 39).

4. The isolated antibody, or Fab fragment thereof, of any one of claim 1, 2, or 3, wherein the antibody comprises the following amino acid sequence as its heavy chain variable domain (VH):
EVQLVESGGGLVQPGGSLRLSCAASGFTINASWIH
WVRQAPGKGLEWVGAIYPYSGYTNYADSVKG
RFTISADTSKNTAYLQMNSLRAEDTAVYYCARW
GHSTSPWAMDYWGQGTLVTVSSASTKGPSVFPL
APSSKSTSGGTAALGCLVKDYFPEPVTVSWNSG
ALTSGVHTFPAVLQSSGLYSLSSVVTVPSSSLGT
QTYICNVNHKPSNTKVDKKVEPKSCDKTH (SEQ
ID NO: 38).

5. An isolated antibody, or an Fab fragment thereof, capable of binding to mouse VEGF and human VEGF with Kd values within 10 fold of the other, wherein the antibody is capable of inhibiting the binding of VEGF to a VEGF receptor and wherein the antibody comprises a CDR-H1 comprising the amino acid sequence GSWIF (SEQ ID NO: 938), a CDR-H2 comprising the amino acid sequence AIWPFGGYTHYADSVKG (SEQ ID NO: 941), a CDR-H3 comprising the amino acid sequence WGHSTSPWAMDY (SEQ ID NO: 932), a CDR-L1 comprising the amino acid sequence RASQVIRRSLA (SEQ ID NO: 117), a CDR-L2 comprising the amino acid sequence AASNLAS (SEQ ID NO: 118), and a CDR-L3 comprising the amino acid sequence QQSNTSPLT (SEQ ID NO: 119).

6. An isolated antibody, or an Fab fragment thereof, capable of binding to mouse VEGF and human VEGF with Kd values within 10 fold of the other, wherein the antibody is capable of inhibiting the binding of VEGF to a VEGF receptor and wherein the antibody comprises a CDR-H1 comprising the amino acid sequence GSWIF (SEQ ID NO: 938), a CDR-H2 comprising the amino acid sequence AIWPFGGYTHYADSVKG (SEQ ID NO: 941), a CDR-H3 comprising the amino acid sequence WGHSTSPWAMDY (SEQ ID NO: 932), and wherein the antibody further comprises the following amino acid sequence as its light chain variable domain (VL):
DIQMTQSPSSLSASVGDRVTITCRASQVIRRSLAWY
QQKPGKAPKLLIYAASNLASGVPSRFSGSGSGT
DFTLTISSLQPEDFATYYCQQSNTSPLTFGQGTK
VEIKRTVAAPSVFIFPPSDEQLKSGTASVVCLLNN
FYPREAKVQWKVDNALQSGNSQESVTEQDSKD
STYSLSSTLTLSKADYEKHKVYACEVTHQGLSS
PVTKSFNRGEC (SEQ ID NO: 40).

7. The isolated antibody, or Fab fragment thereof, according to claim 5 or 6, wherein the antibody comprises the following amino acid sequence as its heavy chain variable domain (VH):
EVQLVESGGGLVQPGGSLRLSCAASGFSTNGSWJF
WVRQAPGKGLEWVGAJWPFGGYTHYADSVKG
RFTISADTSKNTAYLQMNSLRAEDTAVYYCARW
GHSTSPWAMDYWGQGTLVTVSSASTKGPSVFP
LAPSSKSTSGGTAALGCLVKDYFPEPVTVSWNS
GALTSGVHTFPAVLQSSGLYSLSSVVTVPSSSLGT
QTYICNVNHKPSNTKVDKKVEPKSCDKTH (SEQ
ID NO: 41).

8. An isolated antibody, or Fab fragment thereof, capable of binding to mouse VEGF and human VEGF with Kd values within 10 fold of the other, wherein the antibody comprises the following amino acid sequence as its heavy chain variable domain (VH):
EVQLVESGGGLVQPGGSLRLSCAASGFTTNASWJH
WVRQAPGKGLEWVGAJYPYSGYTNYADSVKG
RFTISADTSKNTAYLQMNSLRAEDTAVYYCARW
GHSTSPWAMDYWGQGTLVTVSSASTKGPSVFPL
APSSKSTSGGTAALGCLVKDYFPEPVTVSWNSG
ALTSGVHTFPAVLQSSGLYSLSSVVTVPSSSLGT
QTYICNVNHKPSNTKVDKKVEPKSCDKTH (SEQ
ID NO: 38)
and wherein the antibody further comprises one of the following amino acid sequence as its light chain variable domain (VL):
DIQMTQSPSSLSASVGDRVTITCRASQDVSTAVAW
YQQKPGKAPKLLIYSASFLYSGVPSRFSGSGSGT
DFTLTJSSLQPEDFATYYCQQSYTTPPTFGQGTK
VEIKRTVAAPSVFIFPPSDEQLKSGTASVVCLLN
NFYPREAKVQWKVDNALQSGNSQESVTEQDSK
DSTYSLSSTLTLSKADYEKHKVYACEVTHQGLS
SPVTKSFNRGEC (SEQ ID NO 37)
or
DIQMTQSPSSLSASVGDRVTITCRASQVIRRSLAW
YQQKPGKAPKLLIYAASNLASGVPSRFSGSGSG
TDFTLTJSSLQPEDFATYYCQQSNTSPLTFGQGT
KVEIKRTVAAPSVFIFPPSDEQLKSGTASVVCLL
NNFYPREAKVQWKVDNALQSGNSQESVTEQDS
KDSTYSLSSTLTLSKADYEKHKVYACEVTHQGL
SSPVTKSFNRGEC (SEQ ID NO: 39).

9. An isolated antibody, or Fab fragment thereof, capable of binding to mouse VEGF and human VEGF with Kd values within 10 fold of the other, wherein the antibody comprises the following amino acid sequence as its heavy chain variable domain (VH):
EVQLVESGGGLVQPGGSLRLSCAASGFSJNGSWIF
WVRQAPGKGLEWVGAIWPFGGYTHYADSVKG
RFTISADTSKNTAYLQMNSLRAEDTAVYYCARW
GHSTSPWAMDYWGQGTLVTVSSASTKGPSVFP
LAPSSKSTSGGTAALGCLVKDYFPEPVTVSWNS
GALTSGVHTFPAVLQSSGLYSLSSVVTVPSSSLGT
QTYICNVNHKPSNTKVDKKVEPKSCDKTH (SEQ
ID NO: 41)
and wherein the antibody comprises the following amino acid sequence as its light chain variable domain (VL):
DIQMTQSPSSLSASVGDRVTITCRASQVIRRSLAWY
QQKPGKAPKLLIYAASNLASGVPSRFSGSGSGTD
FTLTISSLQPEDFATYYCQQSNTSPLTFGQGTKVE
IKRTVAAPSVFIFPPSDEQLKSGTASVVCLLNNFY
PREAKVQWKVDNALQSGNSQESVTEQDSKDST
YSLSSTLTLSKADYEKHKVYACEVTHQGLSSPV
TKSFNRGEC (SEQ ID NO: 40).

10. The isolated antibody, or Fab fragment thereof, of claim 1, 2, 3, 5, 6, 8, or 9, wherein the antibody is a monoclonal antibody.

11. The isolated antibody, or Fab fragment thereof, of claim 10, wherein the antibody is a chimeric, humanized, or human antibody.

12. The isolated antibody, or Fab fragment thereof, of claim 1, 2, 3, 5, 6, 8, or 9, wherein the antibody is a bispecific antibody.

13. The isolated antibody, or Fab fragment thereof, of claim 1, 2, 3, 5, 6, 8, or 9, wherein the antibody is a synthetic antibody.

\* \* \* \* \*

UNITED STATES PATENT AND TRADEMARK OFFICE
CERTIFICATE OF CORRECTION

| | | |
|---|---|---|
| PATENT NO. | : 7,691,977 B2 | Page 1 of 10 |
| APPLICATION NO. | : 11/583994 | |
| DATED | : April 6, 2010 | |
| INVENTOR(S) | : Fuh et al. | |

It is certified that error appears in the above-identified patent and that said Letters Patent is hereby corrected as shown below:

On the title page, under Item (56) OTHER PUBLICATIONS, in Berkman et al., replace "Vasculer" with --Vascular--.

On page 3, under Item (56) OTHER PUBLICATIONS, in van Besien et al., replace "Churchill Livinstone" with --Churchill Livingstone--;

Under Item (56) OTHER PUBLICATIONS, in Yelton et al., replace "1994-2994" with --1994-2004--.

Column 1, Line 37, replace "vascular network" with --vascular networks--;

Line 53, replace "cascade of process" with --cascade of processes--;

Column 6, Line 32, replace "183" with --I83--;

Line 33, replace "epitope of includes" with --epitope includes--.

Column 7, Line 7, replace "contigous" with --contiguous--;

Line 8, replace "$X_1X_2X_{3z}IH$" with --$X_1X_2X_3IH$-- ;

Line 39, replace "contigous" with --contiguous--;

Line 54, replace "CDR-H11" with --CDR-H1--.

Column 8, Lines 7-8, replace "According to one embodiment, antibody" with --According to one embodiment, the antibody--;

Signed and Sealed this
Fourteenth Day of February, 2012

David J. Kappos
*Director of the United States Patent and Trademark Office*

CERTIFICATE OF CORRECTION (continued)

U.S. Pat. No. 7,691,977 B2

Column 8, Lines 13-14, replace "comparible" with --comparable--;

Line 33, replace "comprises variant amino acid" with --comprises variant amino acids--;

Line 54, replace "is conjugated" with --conjugated--;

Line 60, replace "The invention also provide" with --The invention also provides--.

Column 10, Line 17, replace "are can be can be used" with --can be used--;

Line 34-35, replace "with an anti-VEGF antibodies" with --with an anti-VEGF antibody--;

Line 56, replace "was used as control" with --was used as a control--.

Column 12, Line 52, replace "IC5$_{o,wt}$" with --IC$_{50,\ wt}$--;

Lines 40-41, replace "affinities for as measured" with --affinities as measured--.

Column 13, Line 27-28, replace "respectively (SEQ ID NO. 28-29)." with --respectively (SEQ ID NO. 28 and 31).--;

Line 28, replace "The underlines indicates" with --The underlines indicate--;

Lines 36-37, replace "shows the amino acid sequences the amino acid sequences" with --shows the amino acid sequences--.

Column 19, Line 41, replace "Ghctie, V et al." with --Ghetie, V et al.--;

Line 49, replace "or other polypeptide" with --or other polypeptides--.

Column 20, Line 41-42, replace "an polynucleotide" with --a polynucleotide--;

Line 42, replace "an polypeptide" with --a polypeptide--;

Line 53, replace "Anti-angiogensis" with --Anti-angiogenesis--.

Column 21, Line 2, replace "VEGF(L109)" with --VEGF(109)--;

Lines 10-11, replace "non-absorbant plate" with --non-absorbent plate--;

Column 21, Line 44, replace "simultaneous fitting" with --simultaneously fitting--;

Line 49, replace "is can be determined" with --can be determined--.

Column 22, Line 12, replace ""simultaneous fitting" with --simultaneously fitting--.

CERTIFICATE OF CORRECTION (continued)
U.S. Pat. No. 7,691,977 B2

Column 23, Lines 26-27, replace "205-0216" with --215-216--.

Column 24, Line 63, replace "blood vessels" with --blood vessel--;

Line 67, replace "normally required" with --normally is required--.

Column 25, Line 7, replace "Bechets disease" with --Behcet's disease--;

Line 19, replace "Pagets disease" with --Paget's disease--;

Line 24, replace "Sogrens syndrome" with --Sjogren's syndrome--;

Line 25, replace "Stargarts disease" with --Stargardt's disease--;

Line 25, replace "Steven's Johnson disease" with --Stevens Johnson disease--;

Column 25, Line 31, replace "Wegeners sarcoidosis" with --Wegener's sarcoidosis--;

Line 49, replace "abnormal blood of vessels" with --abnormal growth of blood vessels--.

Column 26, Line 35, replace "vulval cancer" with --vulvar cancer--;

Line 67, replace "polypeptide" with --polypeptides--.

Column 28, Line 55, replace "abherant" with --aberrant--.

Column 31, Line 29, replace "In other embodiment" with --In other embodiments--;

Lines 45-46, replace "an binding affinity assay" with --a binding affinity assay--;

Lines 55-56, replace "species, than" with --species than--.

Column 33, Line 1, replace "being testing" with --being tested--.

Column 35, Line 30, replace "N-aceylgalactosamine" with --N-acetylgalactosamine--;

Line 47, replace "also provide" with --also provides--;

Column 35, Lines 50-51, replace "based on single" with --based on a single--.

Column 36, Line 50, replace "by using KNK, DVK, and NVK codon sets" with --by using NNK, DVK, and NVK codon sets--;

Line 53, replace "diversities" with --diversification--.

CERTIFICATE OF CORRECTION (continued)

U.S. Pat. No. 7,691,977 B2

Column 37, Line 36, replace "and pooled or oligonucleotides" with --or oligonucleotides--;

Line 44, replace "ELISA assay" with --ELISA assays--;

Line 44, replace "spot competition assay." with --spot competition assays.--;

Line 66, replace "30,31" with --30, 31--.

Column 38, Line 19, replace "synthethized" with --synthesized--.

Column 44, Lines 4-5, replace "microcapsule" with --microcapsules--.

Column 48, Line 36, replace "ACR50" with --ACR 50--;

Line 37, replace "ACR70" with --ACR 70--.

Column 50, Line 26-27, replace "vector" with --vectors--;

Column 50, Line 31, replace "variable CDRs sequences" with --variable CDR sequences--;

Line 35, replace "(marks et al)." with --(Marks et al).--;

Line 38, replace "For single framework library," with --For a single framework library,--;

Line 44, replace "building synthetic" with --building a synthetic--;

Line 47, replace "natural antibodies repertoires" with --natural antibody repertoires--;

Line 50, replace "heavy chain" with --heavy chains--.

Column 52, Line 8-9, replace "structure the VEGF-VEGFR" with --structure of the VEGF-VEGFR--;

Line 11, replace "that the bindings" with --the bindings--;

Lines 39-40, replace "epitope" with --epitopes--;

Lines 46-47, replace "epitopes that matches" with --epitopes that match--;

Line 47, replace "with those of receptor on VEGF" with --with those of receptors on VEGF--;

Column 52, Line 57, replace "ELSA" with --ELISA--;

Line 62, replace "R&D System" with --R&D Systems--.

CERTIFICATE OF CORRECTION (continued)

Column 52, Line 28, replace "Also used as control" with --Also used as controls--;

Line 59, replace "on to 96-well filter plate" with --onto a 96-well filter plate--.

Column 54, Line 27, replace "for different length of time" with --for different lengths of time--;

Lines 27-28, replace "at different temperature" with --at different temperatures--;

Line 46, replace "to improve B20 clone" with --to improve B20 clones--;

Line 47, replace "condition was" with --conditions were--.

Column 55, Line 47, replace "simultaneous fitting" with --simultaneously fitting--;

Line 61, replace "interact" with --interacted--;

Line 63, replace "on VEGF coated 96-well plate" with --on VEGF coated 96-well plates--;

Line 64, replace "The two IC50s values" with --The two IC50 values--.

Column 56, Lines 43-44, replace "25 C." with --25° C.--.

Column 57, Line 55, replace "An Fab-12 variant" with --A Fab-12 variant--;

Line 57, replace "25 C" with --25° C.--.

Column 59, Table, under Oligo L3-H1, replace "GCA ACT TAT TAC TGT VAR VAR KCC TWC ASC ASC CCT SCA ACG TTC GGA GAG GGT ACC (SEQ ID NO: 15)" with --GCA ACT TAT TAC TGT VAR VAR KCC TWC ASC ASC CCT SCA ACG TTC GGA CAG GGT ACC (SEQ ID NO: 15)--.

Column 60, Lines 33-34, replace "and is be schematically" with --and is schematically--.

Column 61, Line 16, replace "2 hour" with --2 hours--;

Line 41, replace "2 hour" with --2 hours--;

Line 55, replace "parenthesis" with --parentheses--;

Line 66, replace "used previously modified" with --used a previously modified--.

CERTIFICATE OF CORRECTION (continued)

U.S. Pat. No. 7,691,977 B2

Column 62, Lines 4-5, replace "point mutation" with --point mutations--;

Lines 6-7, replace "and single colony was picked" with --and a single colony was picked--;

Line 41, replace "two resides" with --two residues--;

Line 45, replace "with single mutation" with --with a single mutation--.

Column 63, Line 35, replace "vise versa" with --vice versa--;

Line 43, replace "This intriguing observations" with --These intriguing observations--;

Line 57-58, replace "in both shotgun scanning" with --in both shotgun scannings--.

Column 66, Lines 25-26, replace "result in lost of binding affinity." with --result in loss of binding affinity.--;

Table 2, under "Single Spot Summary", replace "Selection Critieria" with --Selection Criteria--;

Table 2, under caption, replace "Similar selection crieria" with --Similar selection criteria--;

Table 2, under caption, replace "expected to show less affinity improvment" with --expected to show less affinity improvement--;

Table 2, under caption, replace "G6 alanine and homologe libraries" with --G6 alanine and homolog libraries--.

Column 67, Line 66, replace "and only few mutations" with --and only a few mutations--.

Line 66-67, replace "mutations present among the clones studied" with --mutations present among the clones were studied--;

Column 68, Lines 60-61: replace "Phe17, Tyr21, Tyr, Ile83 and Gln89" with --Phe17, Tyr21, Tyr25, Ile83 and Gln89--;

Line 66, replace "forming complex" with --forming a complex--.

Column 69, Line 29, replace "There was no" with --There were no--;

Line 45, replace "alanine mutation" with --alanine mutations--.

Column 70, Line 67, replace "antibod" with --antibody--.

CERTIFICATE OF CORRECTION (continued)
U.S. Pat. No. 7,691,977 B2

Column 74, Line 29, replace "as others bound" with --as others, bound--;

Line 32, replace "effected" with --affected--;

Line 47, replace "20's helix" with --20s helix--;

Line 60, replace "Tetrinomial Diversity Libraries" with --Tetranomial Diversity Libraries--;

Line 62, replace "a small subsets" with --a small subset--;

Line 64, replace "maybe" with --naïve--.

Column 75, Line 49, replace "propogated" with --propagated--;

Line 58, replace "immunosorbant" with --immunosorbent--.

Column 76, Line 9, replace "d. YADS1, 2 and 3 Fab Binding Affinities" with --e. YADS1, 2 and 3 Fab Binding Affinities--;

Lines 19-20, replace "c. Affinity" with --d. Affinity--;

Lines 37-44, replace "YADS2 Light Chain (SEQ ID NO: 21)
```
DIQMTQSPSSLSASVGDRVTITCRASQSYAYAVAWYQQKPGKAPKLLIYD
ASYLYSGVPSRFSGSGSGTDFTLTISSLQPEDFATYYCQQAYSSPDTFGQ
GTKVE1KRTVAAPSVFWPPSDEQLKSGTASVVCLLNTTTYPREAKVQWKV
DNALQSGNSQESVTEQDSKDSTYSLSSTLTLSKADYEKHKVYACEVTHQG
LSSPVTKSFNRGEC
```
"
with
--YADS2 Light Chain (SEQ ID NO: 21)
```
DIQMTQSPSSLSASVGDRVTITCRASQSYAYAVAWYQQKPGKAPKLLIYD
ASYLYSGVPSRFSGSGSGTDFTLTISSLQPEDFATYYCQQAYSSPDTFGQ
GTKVEIKRTVAAPSVFIFPPSDEQLKSGTASVVCLLNNFYPREAKVQWKV
DNALQSGNSQESVTEQDSKDSTYSLSSTLTLSKADYEKHKVYACEVTHQG
LSSPVTKSFNRGEC
```
--.

Column 77, Lines 46-55, replace "YADS2 Heavy Chain (SEQ ID NO: 22)
```
MKKNIAELLASMFVFSIATNAYAEVQLVESGGGLVQPGGSLRLSCAASGF
AISDYDIHWVRQAPGKGLIWVAD1APYAGATAYADSVKGRFTISADTSKN
TAYLQMNSLREDTVYYCSRSSYAYYAAMDYWGQGTLVTVSSASTKGPSVF
PLAPSSKSTSGGTAALGCLVKDYFPEPVTVSWNSGALTSGVHTFPAVLQS
SGLYSLSSVVTVPSSSLGTQTYICNVKUKiPSNTKVDKKVEPKSCDKTH
```
"
with
--YADS2 Heavy Chain (SEQ ID NO: 22)

CERTIFICATE OF CORRECTION (continued)
U.S. Pat. No. 7,691,977 B2

```
MKKNIAFLLASMFVFSIATNAYAEVQLVESGGGLVQPGGSLRLSCAASGF
AISDYDIHWVRQAPGKGLEWVADIAPYAGATAYADSVKGRFTISADTSKN
TAYLQMNSLRAEDTAVYYCSRSSYAYYAAMDYWGQGTLVTVSSASTKGPSVF
PLAPSSKSTSGGTAALGCLVKDYFPEPVTVSWNSGALTSGVHTFPAVLQS
SGLYSLSSVVTVPSSSLGTQTYICNVNHKPSNTKVDKKVEPKSCDKTH  --.
```

Column 78, Lines 3-11, replace "YADS3 Light Chain (SEQ ID NO: 23)
```
DIQMTQSPSSLSASVGDRVTITCRASQASYYDVAWYQQKPGKAPKLLIYA
ASYLYSGVPSRFSGSGSGTDFTLTISSLQPEDFATYYCQQYYYAPATFGQ
GTKVEIIKRTVAAPSVFTFPPSDEQLKSGTASVVCLLNNFYPREAKVQWK
VDNALQSGNSQESVTEQDSKDSTYSLSSTLTLSKADYEKHKVYACEVTHQ
GLSSPVTKSFNRGEC
```
with
--YADS3 Light Chain (SEQ ID NO: 23)
```
DIQMTQSPSSLSASVGDRVTITCRASQASYYDVAWYQQKPGKAPKLLIYA
ASYLYSGVPSRFSGSGSGTDFTLTISSLQPEDFATYYCQQYYYAPATFGQ
GTKVEIIKRTVAAPSVFIFPPSDEQLKSGTASVVCLLNNFYPREAKVQWK
VDNALQSGNSQESVTEQDSKDSTYSLSSTLTLSKADYEKHKVYACEVTHQ
GLSSPVTKSFNRGEC                                    --;
```

Column 78, Lines 14-21, replace "YADS3 Heavy Chain (SEQ ID NO: 24)
```
MKKNIAFLLASMFVFSIATNAYAEVQLVESGGGLVQPGGSLRLSCAASGF
SISDYDIHWVRQAPGKGLEWVAAIAPYSGSTYYADSVKGRETISADTSKN
TAYLQMNSLRAEDTAVYYCSRSSYAYYSAMDYWGQGTLVTVSSASTKGPS
VFPLAPSSKSTSGGTAALGCLVKDYFPEPVTVSWNSGALTSGVHTFPAVL
QSSGLYSLSSVVTVPSSSLGTQTYICNVNHKPSNTKVDKKVEPKSCDKTH "
```
with
--YADS3 Heavy Chain (SEQ ID NO: 24)
```
MKKNIAFLLASMFVFSIATNAYAEVQLVESGGGLVQPGGSLRLSCAASGF
SISDYDIHWVRQAPGKGLEWVAAIAPYSGSTYYADSVKGRFTISADTSKN
TAYLQMNSLRAEDTAVYYCSRSSYAYYSAMDYWGQGTLVTVSSASTKGPS
VFPLAPSSKSTSGGTAALGCLVKDYFPEPVTVSWNSGALTSGVHTFPAVL
QSSGLYSLSSVVTVPSSSLGTQTYICNVNHKPSNTKVDKKVEPKSCDKTH --.
```

Column 80, Line 25, replace "parantheses" with --parentheses--;

Lines 34-36, replace "VEGF antibody that is buried in VEGF ($Å^2$) is reported below together with" with --VEGF antibody that is buried in VEGF ($Å^2$) together with--.

Column 83, Line 66, replace "were randomized were randomized" with --were randomized--.

Column 85, Line 49, replace "YADS2 fab" with --YADS2 Fab--.

Column 87, Line 4, replace "constants, Kd values were calculated" with --constants, Kd values, were calculated--.

Column 89, Line 49, replace "Kd values from" with --Kd values, from--.

CERTIFICATE OF CORRECTION (continued)
U.S. Pat. No. 7,691,977 B2

Column 91, Line 28, replace "$k_a\ (10^4 \cdot M_{-1} \cdot s^{-1})$" with --$k_a\ (10^4 \cdot M^{-1} \cdot s^{-1})$--.

Column 92, Line 11, replace "Fe (50 mg/kg)" with --Fc (50 mg/kg)--;

Line 54, replace "cells LL2 cells" with --LL2 cells--.

Column 93, Line 8, replace "until confluence" with --until confluent--.

Column 94, Line 22, replace "G6-31 antibodies, which antibodies bind similar" with --G6-31 antibodies, which bind similar--;

Line 52, claim 3, replace "following amino acid sequence" with --following amino acid sequences--.

Column 95, Lines 52-59, claim 7, replace
```
   EVQLVESGGGLVQPGGSLRLSCAASGFSTNGSWJFWVRQAPGKGLEWVGAJWPF
   GGYTHYADSVKGRFTISADTSKNTAYLQMNSLRAEDTAVYYCARWGHSTSPWA
   MDYWGQGTLVTVSSASTKGPSVFPLAPSSKSTSGGTAALGCLVKDYFPEPVTVS
   WNSGALTSGVHTFPAVLQSSGLYSLSSVVTVPSSSLGTQTYICNVNHKPSNTKVD
" KKVEPKSCDKTH (SEQ ID NO: 41)                              ."
```
with
```
   EVQLVESGGGLVQPGGSLRLSCAASGFSINGSWIFWVRQAPGKGLEWVGAIWPF
   GGYTHYADSVKGRFTISADTSKNTAYLQMNSLRAEDTAVYYCARWGHSTSPWA
   MDYWGQGTLVTVSSASTKGPSVFPLAPSSKSTSGGTAALGCLVKDYFPEPVTVS
   WNSGALTSGVHTFPAVLQSSGLYSLSSVVTVPSSSLGTQTYICNVNHKPSNTKVD
-- KKVEPKSCDKTH (SEQ ID NO: 41)                             .--.
```

Column 96, Lines 1-8, claim 8, replace
```
   EVQLVESGGGLVQPGGSLRLSCAASGFTTNASWJHWVRQAPGKGLEWVGAJYPYSGYTN
   YADSVKGRFTISADTSKNTAYLQMNSLRAEDTAVYYCARWGHSTSPWA
   MDYWGQGTLVTVSSASTKGPSVFPLAPSSKSTSGGTAALGCLVKDYFPEPVTVS
   WNSGALTSGVHTFPAVLQSSGLYSLSSVVTVPSSSLGTQTYICNVNHKPSNTKVD
" KKVEPKSCDKTH (SEQ ID NO: 38)                              "
```
with
```
   EVQLVESGGGLVQPGGSLRLSCAASGFTINASWIHWVRQAPGKGLEWVGAIYPY
   SGYTNYADSVKGRFTISADTSKNTAYLQMNSLRAEDTAVYYCARWGHSTSPWA
   MDYWGQGTLVTVSSASTKGPSVFPLAPSSKSTSGGTAALGCLVKDYFPEPVTVS
   WNSGALTSGVHTFPAVLQSSGLYSLSSVVTVPSSSLGTQTYICNVNHKPSNTKVD
-- KKVEPKSCDKTH (SEQ ID NO: 38)                             --;
```

Line 10, claim 8, replace "following amino acid sequence" with --following amino acid sequences--.

CERTIFICATE OF CORRECTION (continued)
U.S. Pat. No. 7,691,977 B2

Lines 12-18, claim 8, replace

" DIQMTQSPSSLSASVGDRVTITCRASQDVSTAVAWYQQKPGKAPKLLIYSASFLY
SGVPSRFSGSGSGTDFTLTJSSLQPEDFATYYCQQSYTTPPTFGQGTKVEIKRTVAA
PSVFIFPPSDEQLKSGTASVVCLLNNFYPREAKVQWKVDNALQSGNSQESVTEQD
SKDSTYSLSSTLTLSKADYEKHKVYACEVTHQGLSSPVTKSFNRGEC (SEQ ID NO
37) "

with

-- DIQMTQSPSSLSASVGDRVTITCRASQDVSTAVAWYQQKPGKAPKLLIYSASFLY
SGVPSRFSGSGSGTDFTLTISSLQPEDFATYYCQQSYTTPPTFGQGTKVEIKRTVAA
PSVFIFPPSDEQLKSGTASVVCLLNNFYPREAKVQWKVDNALQSGNSQESVTEQD
SKDSTYSLSSTLTLSKADYEKHKVYACEVTHQGLSSPVTKSFNRGEC (SEQ ID NO
37) --;

Lines 21-27, claim 8, replace

" DIQMTQSPSSLSASVGDRVTITCRASQVIRRSLAWYQQKPGKAPKLLIYAASNLAS
GVPSRFSGSGSGTDFTLTJSSLQPEDFATYYCQQSNTSPLTFGQGTKVEIKRTVAAP
SVFIFPPSDEQLKSGTASVVCLLNNFYPREAKVQWKVDNALQSGNSQESVTEQDS
KDSTYSLSSTLTLSKADYEKHKVYACEVTHQGLSSPVTKSFNRGEC (SEQ ID NO:
39) "

with

-- DIQMTQSPSSLSASVGDRVTITCRASQVIRRSLAWYQQKPGKAPKLLIYAASNLAS
GVPSRFSGSGSGTDFTLTISSLQPEDFATYYCQQSNTSPLTFGQGTKVEIKRTVAAP
SVFIFPPSDEQLKSGTASVVCLLNNFYPREAKVQWKVDNALQSGNSQESVTEQDS
KDSTYSLSSTLTLSKADYEKHKVYACEVTHQGLSSPVTKSFNRGEC (SEQ ID NO:
39) --;

Column 96, Lines 33-40, claim 9, replace

" EVQLVESGGGLVQPGGSLRLSCAASGFSJNGSWIFWVRQAPGKGLEWVGAIWPF
GGYTHYADSVKGRFTISADTSKNTAYLQMNSLRAEDTAVYYCARWGHSTSPWA
MDYWGQGTLVTVSSASTKGPSVFPLAPSSKSTSGGTAALGCLVKDYFPEPVTVS
WNSGALTSGVHTFPAVLQSSGLYSLSSVVTVPSSSLGTQTYICNVNHKPSNTKVD
KKVEPKSCDKTH (SEQ ID NO: 41) "

with

-- EVQLVESGGGLVQPGGSLRLSCAASGFSINGSWIFWVRQAPGKGLEWVGAIWPF
GGYTHYADSVKGRFTISADTSKNTAYLQMNSLRAEDTAVYYCARWGHSTSPWA
MDYWGQGTLVTVSSASTKGPSVFPLAPSSKSTSGGTAALGCLVKDYFPEPVTVS
WNSGALTSGVHTFPAVLQSSGLYSLSSVVTVPSSSLGTQTYICNVNHKPSNTKVD
KKVEPKSCDKTH (SEQ ID NO: 41) --.